United States Patent 9,624,556 (VIRAL AND VIRAL ASSOCIATED MIRNAS AND USES THEREOF) - sequence listing, part 19

SEQ ID NO: 553749 - DNA, 22 bp, Homo sapiens
tcctgtcgccccaggcccggtg

SEQ ID NO: 553750 - DNA, 22 bp, Homo sapiens
acattttgtattttttgagtcg

SEQ ID NO: 553751 - DNA, 22 bp, Homo sapiens
tttggttttctcttggcggaag

SEQ ID NO: 553752 - DNA, 22 bp, Homo sapiens
tctcatggagttaatactggga

SEQ ID NO: 553753 - DNA, 22 bp, Homo sapiens
agttacggctcataaacctgga

SEQ ID NO: 553754 - DNA, 22 bp, Homo sapiens
ttaattgcaagtggtccttgtt

SEQ ID NO: 553755 - DNA, 22 bp, Homo sapiens
taatgcccctaaaaatccttat

SEQ ID NO: 553756 - DNA, 22 bp, Homo sapiens
taatagaggtaatagttgaaat

SEQ ID NO: 553757 - DNA, 22 bp, Homo sapiens
ttccttctaaaagctgaaggct

SEQ ID NO: 553758 - DNA, 22 bp, Homo sapiens
ggtggcttcctgtcagtttggt

SEQ ID NO: 553759 - DNA, 22 bp, Homo sapiens
tcctgccctggatggtccagag

SEQ ID NO: 553760 - DNA, 22 bp, Homo sapiens
agcactgaacgcagcattcttg

SEQ ID NO: 553761 - DNA, 22 bp, Homo sapiens
tcaacactgttggcggggacct

SEQ ID NO: 553762 - DNA, 22 bp, Homo sapiens
tggggaagtctgagcggcagtt

SEQ ID NO: 553763 - DNA, 22 bp, Homo sapiens
tggcaataaatacatctgggca

SEQ ID NO: 553764 - DNA, 22 bp, Homo sapiens
tttgatgcttaatgaaaagtga

SEQ ID NO: 553765 - DNA, 22 bp, Homo sapiens
tgcatcaatcaatagggctttt

SEQ ID NO: 553766 - DNA, 22 bp, Homo sapiens
ggaaataatggagggcagggag

SEQ ID NO: 553767 - DNA, 22 bp, Homo sapiens
tcatcggagaaactccctgcga

SEQ ID NO: 553768 - DNA, 22 bp, Homo sapiens
cccagtgtggcccaagctcctg

SEQ ID NO: 553769 - DNA, 22 bp, Homo sapiens
catgaccttctgggatttgtag

SEQ ID NO: 553770 - DNA, 22 bp, Homo sapiens
gattattttttttacagcatag

SEQ ID NO: 553771 - DNA, 22 bp, Homo sapiens
gtattttgtctatcttttgcat

SEQ ID NO: 553772 - DNA, 22 bp, Homo sapiens
agcccttcatgcccagatctga

SEQ ID NO: 553773 - DNA, 22 bp, Homo sapiens
gaagtgccatagatgagtgaaa

SEQ ID NO: 553774 - DNA, 22 bp, Homo sapiens
tggtatctgtcatcttctgcag

SEQ ID NO: 553775 - DNA, 22 bp, Homo sapiens
gatgtattagagcaatgtatca

SEQ ID NO: 553776 - DNA, 22 bp, Homo sapiens
cagttcatttgattgaacttgg

SEQ ID NO: 553777 - DNA, 22 bp, Homo sapiens
ttgactggatacaggtgtttgc

SEQ ID NO: 553778 - DNA, 22 bp, Homo sapiens
tacatgtgccttaacttcattt

SEQ ID NO: 553779 - DNA, 22 bp, Homo sapiens
tccttatcactgggcctcactt

SEQ ID NO: 553780 - DNA, 22 bp, Homo sapiens
tggcttgttgaatacttggctg

SEQ ID NO: 553781 - DNA, 22 bp, Homo sapiens
tttgaggtaagactgccatgtg

SEQ ID NO: 553782 - DNA, 22 bp, Homo sapiens
ggctagggtgcaggtggggagt

SEQ ID NO: 553783 - DNA, 22 bp, Homo sapiens
tccatgtttcagcatctatgtc

SEQ ID NO: 553784 - DNA, 22 bp, Homo sapiens
tccaagtgaaaatgtcaaataa

SEQ ID NO: 553785 - DNA, 22 bp, Homo sapiens
tgcagaagtccaggacgtaatg

SEQ ID NO: 553786 - DNA, 22 bp, Homo sapiens
agggtgaggaatgtaaggtgga

SEQ ID NO: 553787 - DNA, 22 bp, Homo sapiens
tattcaccatcagtagcagaaa

SEQ ID NO: 553788 - DNA, 22 bp, Homo sapiens
ggagcctccagtatcctcctct

SEQ ID NO: 553789 - DNA, 22 bp, Homo sapiens
tttccacaggatggtgggtggg

SEQ ID NO: 553790 - DNA, 22 bp, Homo sapiens
gaagcaggtggggctgttggga

SEQ ID NO: 553791 - DNA, 22 bp, Homo sapiens
gagagggccttatgccgctgta

SEQ ID NO: 553792 - DNA, 22 bp, Homo sapiens
ctgagctggggagagagggagc

SEQ ID NO: 553793 - DNA, 22 bp, Homo sapiens
cctggctaggcttccacagttg

SEQ ID NO: 553794 - DNA, 22 bp, Homo sapiens
tctgggttccctcccccaattg

SEQ ID NO: 553795 - DNA, 22 bp, Homo sapiens
attagagcagatgtaggcacag

SEQ ID NO: 553796 - DNA, 22 bp, Homo sapiens
tactatttaggcctcagggtat

SEQ ID NO: 553797 - DNA, 22 bp, Homo sapiens
tgcttcaaaacatcctggaaat

SEQ ID NO: 553798 - DNA, 22 bp, Homo sapiens
cgagacaacatatccgtctcca

SEQ ID NO: 553799 - DNA, 22 bp, Homo sapiens
attgtgatgtcacaaatggagg

SEQ ID NO: 553800 - DNA, 22 bp, Homo sapiens
ggctggggctgaggtctgtcca

SEQ ID NO: 553801 - DNA, 22 bp, Homo sapiens
ttaccgtcaggctatactctcc

SEQ ID NO: 553802 - DNA, 22 bp, Homo sapiens
tacacacaactgaggatcatag

SEQ ID NO: 553803 - DNA, 22 bp, Homo sapiens
tttcttcctttttctttttggc

SEQ ID NO: 553804 - DNA, 22 bp, Homo sapiens
agagtgcaaggccggaagcccc

SEQ ID NO: 553805 - DNA, 22 bp, Homo sapiens
tgatccgggtctggtctgcagc

SEQ ID NO: 553806 - DNA, 22 bp, Homo sapiens
gagccctggtggcagcccaggg

SEQ ID NO: 553807 - DNA, 22 bp, Homo sapiens
actgtgactcggggctgttcag

SEQ ID NO: 553808 - DNA, 22 bp, Homo sapiens
taactgatggactctagcagtc

SEQ ID NO: 553809 - DNA, 22 bp, Homo sapiens
cagaggaggggacagaggctcc

SEQ ID NO: 553810 - DNA, 22 bp, Homo sapiens
ttgtagcttctcaagcaaggtt

SEQ ID NO: 553811 - DNA, 22 bp, Homo sapiens
tccatctcaatttattcctaga

SEQ ID NO: 553812 - DNA, 22 bp, Homo sapiens
ggggttagggggtcagagtaag

SEQ ID NO: 553813 - DNA, 22 bp, Homo sapiens
agcaggctccgggggacaggga

SEQ ID NO: 553814 - DNA, 22 bp, Homo sapiens
ttgctcataccttgtttctttc

SEQ ID NO: 553815 - DNA, 22 bp, Homo sapiens
gagctggctggttggggagaag

SEQ ID NO: 553816 - DNA, 22 bp, Homo sapiens
tccttggtccttccatgaaagc

SEQ ID NO: 553817 - DNA, 22 bp, Homo sapiens
acggttttaccagacagtatta

SEQ ID NO: 553818 - DNA, 22 bp, Homo sapiens
ggagatgctaaaggtaacccct

SEQ ID NO: 553819 - DNA, 22 bp, Homo sapiens
tatgctgatgacatctatcttc

SEQ ID NO: 553820 - DNA, 22 bp, Homo sapiens
tattgatttcagacccagtttt

SEQ ID NO: 553821 - DNA, 22 bp, Homo sapiens
tccagatgtgtatttttagtgc

SEQ ID NO: 553822 - DNA, 22 bp, Homo sapiens
tagtagtagctttaaaaagact

SEQ ID NO: 553823 - DNA, 22 bp, Homo sapiens
caacctggaggactccatgctg

SEQ ID NO: 553824 - DNA, 22 bp, Homo sapiens
tcaccacttcttctggaggatt

SEQ ID NO: 553825 - DNA, 22 bp, Homo sapiens
ttggggatcatggttatattcc

SEQ ID NO: 553826 - DNA, 22 bp, Homo sapiens
cccccggtcaggttcagccagc

SEQ ID NO: 553827 - DNA, 22 bp, Homo sapiens
aggtctgctgcagagcatggct

SEQ ID NO: 553828 - DNA, 22 bp, Homo sapiens
atacaataatgggttcaacaaa

SEQ ID NO: 553829 - DNA, 22 bp, Homo sapiens
tttgcaggcactctggagtttt

SEQ ID NO: 553830 - DNA, 22 bp, Homo sapiens
atcactgtttttatgtaatcag

SEQ ID NO: 553831 - DNA, 22 bp, Homo sapiens
gactctagctgccaaaggcgct

SEQ ID NO: 553832 - DNA, 22 bp, Homo sapiens
cctgaagccccgccccttctcc

SEQ ID NO: 553833 - DNA, 22 bp, Homo sapiens
agctgggggactgctttaggag

SEQ ID NO: 553834 - DNA, 22 bp, Homo sapiens
gaagggtggcctcctgaagtgg

SEQ ID NO: 553835 - DNA, 22 bp, Homo sapiens
ccctagggtggcccataggatg

SEQ ID NO: 553836 - DNA, 22 bp, Homo sapiens
tctttttaaagctactactaaa

SEQ ID NO: 553837 - DNA, 22 bp, Homo sapiens
gaagccagggtggaaggggtct

SEQ ID NO: 553838 - DNA, 22 bp, Homo sapiens
aactgtgaggaccaggggtagc

SEQ ID NO: 553839 - DNA, 22 bp, Homo sapiens
ttttctaataagtcacatcttt

SEQ ID NO: 553840 - DNA, 22 bp, Homo sapiens
tcacatgtcttctctgtgggat

SEQ ID NO: 553841 - DNA, 22 bp, Homo sapiens
acactccacaggagactaacat

SEQ ID NO: 553842 - DNA, 22 bp, Homo sapiens
ttggctcctgttcctctgtctg

SEQ ID NO: 553843 - DNA, 22 bp, Homo sapiens
agggtttgttttcgccttctgc

SEQ ID NO: 553844 - DNA, 22 bp, Homo sapiens
acaagaggaagaactgaaattc

SEQ ID NO: 553845 - DNA, 22 bp, Homo sapiens
tgctatttccctcagttgaggg

SEQ ID NO: 553846 - DNA, 22 bp, Homo sapiens
aagcgtccccgtgagaggcccg

SEQ ID NO: 553847 - DNA, 22 bp, Homo sapiens
tgcgtgacgtaggctggcgtgg

SEQ ID NO: 553848 - DNA, 22 bp, Homo sapiens
gatctgtttcaggtctcctcgc

SEQ ID NO: 553849 - DNA, 22 bp, Homo sapiens
attatctgtgtagaacacttaa

SEQ ID NO: 553850 - DNA, 22 bp, Homo sapiens
ccacagtgacacagacctcact

SEQ ID NO: 553851 - DNA, 22 bp, Homo sapiens
ttagttttagctccctattctc

SEQ ID NO: 553852 - DNA, 22 bp, Homo sapiens
tacagggaggctgcagtggagc

SEQ ID NO: 553853 - DNA, 22 bp, Homo sapiens
acagttgatgatgtgcatgtgt

SEQ ID NO: 553854 - DNA, 22 bp, Homo sapiens
tagagagactgagtacttttcc

SEQ ID NO: 553855 - DNA, 22 bp, Homo sapiens
ggcagtgtcaacagtttctaaa

SEQ ID NO: 553856 - DNA, 22 bp, Homo sapiens
tgttttgtcactgtcaacatca

SEQ ID NO: 553857 - DNA, 22 bp, Homo sapiens
agaatttgcacctgtttctagc

SEQ ID NO: 553858 - DNA, 22 bp, Homo sapiens
gactgtgggttcctgggctggg

SEQ ID NO: 553859 - DNA, 22 bp, Homo sapiens
aagaatttacttctggtttata

SEQ ID NO: 553860 - DNA, 22 bp, Homo sapiens
ggcacttttgcaaagaggagca

SEQ ID NO: 553861 - DNA, 22 bp, Homo sapiens
cggcattcttccccacaattaa

SEQ ID NO: 553862 - DNA, 22 bp, Homo sapiens
ttcccttggccccagctcgtcc

SEQ ID NO: 553863 - DNA, 22 bp, Homo sapiens
tcatgctctagaataaacctaa

SEQ ID NO: 553864 - DNA, 22 bp, Homo sapiens
tggacgctgcagccagtgtcta

SEQ ID NO: 553865 - DNA, 22 bp, Homo sapiens
tgagtcttggcttcttggctgt

SEQ ID NO: 553866 - DNA, 22 bp, Homo sapiens
gacctgtccgtggtgctgcttg

SEQ ID NO: 553867 - DNA, 22 bp, Homo sapiens
gcttgtatgatagagtcagcct

SEQ ID NO: 553868 - DNA, 22 bp, Homo sapiens
caagataccaccttttttacca

SEQ ID NO: 553869 - DNA, 22 bp, Homo sapiens
tgtttctgaccttcccaccatt

SEQ ID NO: 553870 - DNA, 22 bp, Homo sapiens
tgggtactataatttgcattgc

SEQ ID NO: 553871 - DNA, 22 bp, Homo sapiens
gtgcggtcacagtgaggtggcc

SEQ ID NO: 553872 - DNA, 22 bp, Homo sapiens
cctcgggtgatggtgggagggc

SEQ ID NO: 553873 - DNA, 22 bp, Homo sapiens
agcagtatatcatttcatggag

SEQ ID NO: 553874 - DNA, 22 bp, Homo sapiens
tcatagttatgttcccagtacc

SEQ ID NO: 553875 - DNA, 22 bp, Homo sapiens
cacttgtgtgggtgtgaaggcg

SEQ ID NO: 553876 - DNA, 22 bp, Homo sapiens
tccataccacactagttttatt

SEQ ID NO: 553877 - DNA, 22 bp, Homo sapiens
agggcaaactctactaagacct

SEQ ID NO: 553878 - DNA, 22 bp, Homo sapiens
tcttagatgcccagttaaatgg

SEQ ID NO: 553879 - DNA, 22 bp, Homo sapiens
tcagattagagaggggaatggg

SEQ ID NO: 553880 - DNA, 22 bp, Homo sapiens
aggcagcaatgaaatagtgctc

SEQ ID NO: 553881 - DNA, 22 bp, Homo sapiens
tttttatatggccagggtgata

SEQ ID NO: 553882 - DNA, 22 bp, Homo sapiens
ccatccctgagcccctttctaa

SEQ ID NO: 553883 - DNA, 22 bp, Homo sapiens
agatttgtgcatgttgaattaa

SEQ ID NO: 553884 - DNA, 22 bp, Homo sapiens
tgcatctttttccaagtttatt

SEQ ID NO: 553885 - DNA, 22 bp, Homo sapiens
caggctaactgggtggaaatga

SEQ ID NO: 553886 - DNA, 22 bp, Homo sapiens
atacataggtagtgagtcatat

SEQ ID NO: 553887 - DNA, 22 bp, Homo sapiens
tcagttcctggagctgctcggg

SEQ ID NO: 553888 - DNA, 22 bp, Homo sapiens
tcctctctgggcactggcctat

SEQ ID NO: 553889 - DNA, 22 bp, Homo sapiens
cagtctgggggcgccggggctt

SEQ ID NO: 553890 - DNA, 22 bp, Homo sapiens
tctggatagagagtcagtggtg

SEQ ID NO: 553891 - DNA, 22 bp, Homo sapiens
caagagtggcagcgggaactga

SEQ ID NO: 553892 - DNA, 22 bp, Homo sapiens
aaatcaagaattttacttaggt

SEQ ID NO: 553893 - DNA, 22 bp, Homo sapiens
aggataatgagtaataggtgat

SEQ ID NO: 553894 - DNA, 22 bp, Homo sapiens
ccaagtcccctcatctttctga

SEQ ID NO: 553895 - DNA, 22 bp, Homo sapiens
gaagccttttggaaaatgtgat

SEQ ID NO: 553896 - DNA, 22 bp, Homo sapiens
tagggactgtggggacaggagg

SEQ ID NO: 553897 - DNA, 22 bp, Homo sapiens
agaactgagactgggaggtatt

SEQ ID NO: 553898 - DNA, 22 bp, Homo sapiens
tggggaagagggagctggaatg

SEQ ID NO: 553899 - DNA, 22 bp, Homo sapiens
ggaagatggcccacatgtagtt

SEQ ID NO: 553900 - DNA, 22 bp, Homo sapiens
tgttagctgtgcaggttacttc

SEQ ID NO: 553901 - DNA, 22 bp, Homo sapiens
tgggcagaggtgaggggctggg

SEQ ID NO: 553902 - DNA, 22 bp, Homo sapiens
ttcaacttataccttctatacc

SEQ ID NO: 553903 - DNA, 22 bp, Homo sapiens
tagggtcacagaccccagccca

SEQ ID NO: 553904 - DNA, 22 bp, Homo sapiens
taagccaaggtctgaagtctga

SEQ ID NO: 553905 - DNA, 22 bp, Homo sapiens
tgtggggagcaggggttctgaa

SEQ ID NO: 553906 - DNA, 22 bp, Homo sapiens
gctgggagttgggtagagagtg

SEQ ID NO: 553907 - DNA, 22 bp, Homo sapiens
gagaggatgcttaatttttttg

SEQ ID NO: 553908 - DNA, 22 bp, Homo sapiens
ccaccctctcagtgttgttttc

SEQ ID NO: 553909 - DNA, 22 bp, Homo sapiens
tattgcactcgtcccggcctcc

SEQ ID NO: 553910 - DNA, 22 bp, Homo sapiens
tctgggggcgaggaaggaggag

SEQ ID NO: 553911 - DNA, 22 bp, Homo sapiens
tgcaggatagatcatcagaatg

SEQ ID NO: 553912 - DNA, 22 bp, Homo sapiens
gactctgaaggtcctgcccctg

SEQ ID NO: 553913 - DNA, 22 bp, Homo sapiens
tcctgggcttagtggctaggtc

SEQ ID NO: 553914 - DNA, 22 bp, Homo sapiens
cgcccttcccccccttcttcac

SEQ ID NO: 553915 - DNA, 22 bp, Homo sapiens
agttgcttttaatgttcctttc

SEQ ID NO: 553916 - DNA, 22 bp, Homo sapiens
tgatctcaacttttcactgggg

SEQ ID NO: 553917 - DNA, 22 bp, Homo sapiens
tgagggattttagacagaaggg

SEQ ID NO: 553918 - DNA, 22 bp, Homo sapiens
tgaatcagactcatgtactgat

SEQ ID NO: 553919 - DNA, 22 bp, Homo sapiens
agggggaaaaaatctccagctt

SEQ ID NO: 553920 - DNA, 22 bp, Homo sapiens
agaatttattgtactgtggtct

SEQ ID NO: 553921 - DNA, 22 bp, Homo sapiens
atgggctgagaggtggccggtg

SEQ ID NO: 553922 - DNA, 22 bp, Homo sapiens
taaaatatatacacacatatac

SEQ ID NO: 553923 - DNA, 22 bp, Homo sapiens
tcaataattacctccagggaca

SEQ ID NO: 553924 - DNA, 22 bp, Homo sapiens
atagaaaagggtcatatgactc

SEQ ID NO: 553925 - DNA, 22 bp, Homo sapiens
tgaggagttcacagttgctgcc

SEQ ID NO: 553926 - DNA, 22 bp, Homo sapiens
gagctggctgtggttgagtgca

SEQ ID NO: 553927 - DNA, 22 bp, Homo sapiens
cattgaactatgcaggctaact

SEQ ID NO: 553928 - DNA, 22 bp, Homo sapiens
agcagagggggcgggggagtgg

SEQ ID NO: 553929 - DNA, 22 bp, Homo sapiens
acttcagatatttaatatatta

SEQ ID NO: 553930 - DNA, 22 bp, Homo sapiens
ggagagccctcagtgtgacccc

SEQ ID NO: 553931 - DNA, 22 bp, Homo sapiens
agtgttggagaccttcagggag

SEQ ID NO: 553932 - DNA, 22 bp, Homo sapiens
atgtcctgagcgtctgtcttgc

SEQ ID NO: 553933 - DNA, 22 bp, Homo sapiens
gacttacacactctgccctgct

SEQ ID NO: 553934 - DNA, 22 bp, Homo sapiens
tcttcactcttctgctgctaga

SEQ ID NO: 553935 - DNA, 22 bp, Homo sapiens
aatcgggccggggtttgggcca

SEQ ID NO: 553936 - DNA, 22 bp, Homo sapiens
ttccaatatttctcacatatgg

SEQ ID NO: 553937 - DNA, 22 bp, Homo sapiens
ttttttttggtaacagggaaca

SEQ ID NO: 553938 - DNA, 22 bp, Homo sapiens
ttttctaggaaatgacagggca

SEQ ID NO: 553939 - DNA, 22 bp, Homo sapiens
gattggaggagtctgatttgtt

SEQ ID NO: 553940 - DNA, 22 bp, Homo sapiens
aatattgcttctatttgtttta

SEQ ID NO: 553941 - DNA, 22 bp, Homo sapiens
aaacaaagccctttatcaagaa

SEQ ID NO: 553942 - DNA, 22 bp, Homo sapiens
tgtgtatgtttgtgtattgctt

SEQ ID NO: 553943 - DNA, 22 bp, Homo sapiens
ttgagccgcagaagtgtcctac

SEQ ID NO: 553944 - DNA, 22 bp, Homo sapiens
atttgcatacacaatcaggcat

SEQ ID NO: 553945 - DNA, 22 bp, Homo sapiens
tgattggagctgcggtgggtgg

SEQ ID NO: 553946 - DNA, 22 bp, Homo sapiens
tgcggaattgcttgagtgaact

SEQ ID NO: 553947 - DNA, 22 bp, Homo sapiens
tcctaactgaatactcacagtt

SEQ ID NO: 553948 - DNA, 22 bp, Homo sapiens
attctcctgggcactggagagc

SEQ ID NO: 553949 - DNA, 22 bp, Homo sapiens
gtggcaccaaaattttctggtt

SEQ ID NO: 553950 - DNA, 22 bp, Homo sapiens
tgttattccccttgctgtggtg

SEQ ID NO: 553951 - DNA, 22 bp, Homo sapiens
tgtcagaggtgacaggggccac

SEQ ID NO: 553952 - DNA, 22 bp, Homo sapiens
taaaaaatgcatctggtgtgtg

SEQ ID NO: 553953 - DNA, 22 bp, Homo sapiens
cgtgaagtctcatgcccctgaa

SEQ ID NO: 553954 - DNA, 22 bp, Homo sapiens
tgccaaatcagtatttcccagg

SEQ ID NO: 553955 - DNA, 22 bp, Homo sapiens
caattgttctttggtctttcag

SEQ ID NO: 553956 - DNA, 22 bp, Homo sapiens
tctggtgagagactggatgtgt

SEQ ID NO: 553957 - DNA, 22 bp, Homo sapiens
gacaaccaaacaggatatttca

SEQ ID NO: 553958 - DNA, 22 bp, Homo sapiens
cagtggggtctctctgtacctc

SEQ ID NO: 553959 - DNA, 22 bp, Homo sapiens
tggctggtttcctgtcccctgg

SEQ ID NO: 553960 - DNA, 22 bp, Homo sapiens
gcttagcacagggtctgcttca

SEQ ID NO: 553961 - DNA, 22 bp, Homo sapiens
gggcttctggtctgcctgccgt

SEQ ID NO: 553962 - DNA, 22 bp, Homo sapiens
catggattcaaagtgaggatta

SEQ ID NO: 553963 - DNA, 22 bp, Homo sapiens
tggtatgctttccagtatctca

SEQ ID NO: 553964 - DNA, 22 bp, Homo sapiens
ttaatatgagcctccggattag

SEQ ID NO: 553965 - DNA, 22 bp, Homo sapiens
cagttcactttttctttctcag

SEQ ID NO: 553966 - DNA, 22 bp, Homo sapiens
agcacctgtcctcgctgctcca

SEQ ID NO: 553967 - DNA, 22 bp, Homo sapiens
tatatgttatggtcccttctaa

SEQ ID NO: 553968 - DNA, 22 bp, Homo sapiens
aggagaggggattttgttacct

SEQ ID NO: 553969 - DNA, 22 bp, Homo sapiens
tttgggccctgaaagcacgcat

SEQ ID NO: 553970 - DNA, 22 bp, Homo sapiens
tcagaccttccttcccaattct

SEQ ID NO: 553971 - DNA, 22 bp, Homo sapiens
cggtgctgggcacccccagggt

SEQ ID NO: 553972 - DNA, 22 bp, Homo sapiens
gatgagctaatggtaatatgaa

SEQ ID NO: 553973 - DNA, 22 bp, Homo sapiens
taggtatatagtgcaaaaactt

SEQ ID NO: 553974 - DNA, 22 bp, Homo sapiens
gaggggtgaaccaaggcaggta

SEQ ID NO: 553975 - DNA, 22 bp, Homo sapiens
tgtgtgtgagagagagagtggc

SEQ ID NO: 553976 - DNA, 22 bp, Homo sapiens
tcccagggtctgagagtcccaa

SEQ ID NO: 553977 - DNA, 22 bp, Homo sapiens
tctcttcaccttgagccctggg

SEQ ID NO: 553978 - DNA, 22 bp, Homo sapiens
tttggggaagtttgggatctgg

SEQ ID NO: 553979 - DNA, 22 bp, Homo sapiens
ggaagggacaagaccaatggga

SEQ ID NO: 553980 - DNA, 22 bp, Homo sapiens
gtggccaattgacttgtggcca

SEQ ID NO: 553981 - DNA, 22 bp, Homo sapiens
tgggctgagtcgtttaatgtgg

SEQ ID NO: 553982 - DNA, 22 bp, Homo sapiens
tcaccctgctttgcggagaatg

SEQ ID NO: 553983 - DNA, 22 bp, Homo sapiens
ttagcctggtccaagggtctcc

SEQ ID NO: 553984 - DNA, 22 bp, Homo sapiens
tgcacaagcaattaggcattta

SEQ ID NO: 553985 - DNA, 22 bp, Homo sapiens
ggagcatttttactagctaggg

SEQ ID NO: 553986 - DNA, 22 bp, Homo sapiens
ccaggcggcccaggagatggcc

SEQ ID NO: 553987 - DNA, 22 bp, Homo sapiens
tcatgctctggggctgaggccg

SEQ ID NO: 553988 - DNA, 22 bp, Homo sapiens
tcttgggatgatttgggaggaa

SEQ ID NO: 553989 - DNA, 22 bp, Homo sapiens
tgtgtggtgggggctttgagct

SEQ ID NO: 553990 - DNA, 22 bp, Homo sapiens
tacatgtgcacaacgtgcaggt

SEQ ID NO: 553991 - DNA, 22 bp, Homo sapiens
tttcgggtgtttttctccagtc

SEQ ID NO: 553992 - DNA, 22 bp, Homo sapiens
agttatataagagatactgaat

SEQ ID NO: 553993 - DNA, 22 bp, Homo sapiens
atttctccaatcactctattgg

SEQ ID NO: 553994 - DNA, 22 bp, Homo sapiens
ctgtgctcaggctccacccact

SEQ ID NO: 553995 - DNA, 22 bp, Homo sapiens
taatgggagaaagggagtacag

SEQ ID NO: 553996 - DNA, 22 bp, Homo sapiens
tttcagcttttcctaaaaggat

SEQ ID NO: 553997 - DNA, 22 bp, Homo sapiens
tctatgatctgttgtctctggt

SEQ ID NO: 553998 - DNA, 22 bp, Homo sapiens
tctttcgccttctgactgttct

SEQ ID NO: 553999 - DNA, 22 bp, Homo sapiens
tgaaccttaggagtccaggggt

SEQ ID NO: 554000 - DNA, 22 bp, Homo sapiens
cagaccagatctaaaattaggc

SEQ ID NO: 554001 - DNA, 22 bp, Homo sapiens
ttctcttttacaggggaggaaa

SEQ ID NO: 554002 - DNA, 22 bp, Homo sapiens
tctgcaggtcagtgtgcagctg

SEQ ID NO: 554003 - DNA, 22 bp, Homo sapiens
tgctaatgacgtctgtggtaaa

SEQ ID NO: 554004 - DNA, 22 bp, Homo sapiens
tggcaacaaattagttctgggg

SEQ ID NO: 554005 - DNA, 22 bp, Homo sapiens
gtgtctccagtagtagacagaa

SEQ ID NO: 554006 - DNA, 22 bp, Homo sapiens
tgtagactctgagtacggtgct

SEQ ID NO: 554007 - DNA, 22 bp, Homo sapiens
acatcctacatatgcaaccagc

SEQ ID NO: 554008 - DNA, 22 bp, Homo sapiens
tcagagtccctcagtggagcgt

SEQ ID NO: 554009 - DNA, 22 bp, Homo sapiens
tttgtctctccattatgattcc

SEQ ID NO: 554010 - DNA, 22 bp, Homo sapiens
cccaagtaagcatccaataaat

SEQ ID NO: 554011 - DNA, 22 bp, Homo sapiens
tgagaagcaaagaactgcactt

SEQ ID NO: 554012 - DNA, 22 bp, Homo sapiens
gggatttggcagcatggcccca

SEQ ID NO: 554013 - DNA, 22 bp, Homo sapiens
tagcaccaaggtaaggtcggct

SEQ ID NO: 554014 - DNA, 22 bp, Homo sapiens
tcaggagaatgtgcagtaatcc

SEQ ID NO: 554015 - DNA, 22 bp, Homo sapiens
tccacatttccccctagaggtg

SEQ ID NO: 554016 - DNA, 22 bp, Homo sapiens
tttagccacatgtgctgaatgt

SEQ ID NO: 554017 - DNA, 22 bp, Homo sapiens
agagaactgaaatggccagcca

SEQ ID NO: 554018 - DNA, 22 bp, Homo sapiens
tgaaaagtgggttcatagggaa

SEQ ID NO: 554019 - DNA, 22 bp, Homo sapiens
tacacaattcttaacatatgta

SEQ ID NO: 554020 - DNA, 22 bp, Homo sapiens
gaggctggatggacttgcctac

SEQ ID NO: 554021 - DNA, 22 bp, Homo sapiens
tttgggggtttgtggatatgtt

SEQ ID NO: 554022 - DNA, 22 bp, Homo sapiens
cccccaggcctcactggctcag

SEQ ID NO: 554023 - DNA, 22 bp, Homo sapiens
ggtgggggcgctgggcggcggc

SEQ ID NO: 554024 - DNA, 22 bp, Homo sapiens
gctcaatggccctaaaaatttc

SEQ ID NO: 554025 - DNA, 22 bp, Homo sapiens
tgatgatctattaatgcaatac

SEQ ID NO: 554026 - DNA, 22 bp, Homo sapiens
tcctgtgtttaccatcttctgc

SEQ ID NO: 554027 - DNA, 22 bp, Homo sapiens
tggctccttaaggtttgtactc

SEQ ID NO: 554028 - DNA, 22 bp, Homo sapiens
gtacattagcactgatggttgc

SEQ ID NO: 554029 - DNA, 22 bp, Homo sapiens
ctggtgactaattatgccctca

SEQ ID NO: 554030 - DNA, 22 bp, Homo sapiens
caggtgggttggtgggcaaggg

SEQ ID NO: 554031 - DNA, 22 bp, Homo sapiens
ttctcccatcatttctccttct

SEQ ID NO: 554032 - DNA, 22 bp, Homo sapiens
agcagtttctctaacagctggg

SEQ ID NO: 554033 - DNA, 22 bp, Homo sapiens
gcggcaaaggcagggaacaggc

SEQ ID NO: 554034 - DNA, 22 bp, Homo sapiens
tcctgctggtcaatcacagccc

SEQ ID NO: 554035 - DNA, 22 bp, Homo sapiens
tgactagagagggttaatgggc

SEQ ID NO: 554036 - DNA, 22 bp, Homo sapiens
caaagcgctcccctttagaggt

SEQ ID NO: 554037 - DNA, 22 bp, Homo sapiens
tgtgtaatatgtttaatatatg

SEQ ID NO: 554038 - DNA, 22 bp, Homo sapiens
tacatttctagtttctaaacaa

SEQ ID NO: 554039 - DNA, 22 bp, Homo sapiens
caggcttctgccacgagaggga

SEQ ID NO: 554040 - DNA, 22 bp, Homo sapiens
agagtccagcatctcagaggcc

SEQ ID NO: 554041 - DNA, 22 bp, Homo sapiens
aaggggcatttagggcagtaga

SEQ ID NO: 554042 - DNA, 22 bp, Homo sapiens
tctggtgtgtatagagttaacc

SEQ ID NO: 554043 - DNA, 22 bp, Homo sapiens
tggtgcatgtttgagcaaacaa

SEQ ID NO: 554044 - DNA, 22 bp, Homo sapiens
tttcatgattgttacttttatc

SEQ ID NO: 554045 - DNA, 22 bp, Homo sapiens
ctctcctcgtcctgtttctttt

SEQ ID NO: 554046 - DNA, 22 bp, Homo sapiens
tttgtccatcagaatgtggggg

SEQ ID NO: 554047 - DNA, 22 bp, Homo sapiens
tgctctaagaaggttgacctgc

SEQ ID NO: 554048 - DNA, 22 bp, Homo sapiens
tcccagggttccacgcctggct

SEQ ID NO: 554049 - DNA, 22 bp, Homo sapiens
atgcccttggagggtagtgggt

SEQ ID NO: 554050 - DNA, 22 bp, Homo sapiens
tccacttccctgctgttctttc

SEQ ID NO: 554051 - DNA, 22 bp, Homo sapiens
gagattctgaagaacttcatca

SEQ ID NO: 554052 - DNA, 22 bp, Homo sapiens
tgagcttagaagtcaggcaggc

SEQ ID NO: 554053 - DNA, 22 bp, Homo sapiens
ccagagtagcaggatctggcag

SEQ ID NO: 554054 - DNA, 22 bp, Homo sapiens
ggggcttgtgagggtttggagt

SEQ ID NO: 554055 - DNA, 22 bp, Homo sapiens
ttatgctgaccagcaaaatgcg

SEQ ID NO: 554056 - DNA, 22 bp, Homo sapiens
gaagaggtaggaacgtagtaag

SEQ ID NO: 554057 - DNA, 22 bp, Homo sapiens
aggtcaggactgtgtgtctggg

SEQ ID NO: 554058 - DNA, 22 bp, Homo sapiens
tgggcttgttgactgggctgga

SEQ ID NO: 554059 - DNA, 22 bp, Homo sapiens
aaatgagaacatagttctgata

SEQ ID NO: 554060 - DNA, 22 bp, Homo sapiens
tccagttgggattcttggttct

SEQ ID NO: 554061 - DNA, 22 bp, Homo sapiens
acaggctatttttggagttgtg

SEQ ID NO: 554062 - DNA, 22 bp, Homo sapiens
ctttggtctggagactcttgct

SEQ ID NO: 554063 - DNA, 22 bp, Homo sapiens
tgcatcattcactgtgggtgac

SEQ ID NO: 554064 - DNA, 22 bp, Homo sapiens
tcatgtgtttcttacataattg

SEQ ID NO: 554065 - DNA, 22 bp, Homo sapiens
cagatgaaaggaaggcatgatt

SEQ ID NO: 554066 - DNA, 22 bp, Homo sapiens
gagctttgtgcttgaattcgtt

SEQ ID NO: 554067 - DNA, 22 bp, Homo sapiens
ggcttttgtggtttgctaaatg

SEQ ID NO: 554068 - DNA, 22 bp, Homo sapiens
ccctaagatacaaatgtcaata

SEQ ID NO: 554069 - DNA, 22 bp, Homo sapiens
accagtggccttaagaaatagg

SEQ ID NO: 554070 - DNA, 22 bp, Homo sapiens
tgtctttgtgctgggatctcat

SEQ ID NO: 554071 - DNA, 22 bp, Homo sapiens
ttctgctctgttttctaatagt

SEQ ID NO: 554072 - DNA, 22 bp, Homo sapiens
tgggattctctggtggtcagaa

SEQ ID NO: 554073 - DNA, 22 bp, Homo sapiens
tctgtaggccacccttgtaggt

SEQ ID NO: 554074 - DNA, 22 bp, Homo sapiens
tgaggcaggtacatttgattat

SEQ ID NO: 554075 - DNA, 22 bp, Homo sapiens
tgaagggctggggctagctctg

SEQ ID NO: 554076 - DNA, 22 bp, Homo sapiens
actgatacttttagtgttagag

SEQ ID NO: 554077 - DNA, 22 bp, Homo sapiens
tgaggataaatagccgaagcac

SEQ ID NO: 554078 - DNA, 22 bp, Homo sapiens
gattcttttttcgcttttacca

SEQ ID NO: 554079 - DNA, 22 bp, Homo sapiens
cctgtcttccacgccctctgcc

SEQ ID NO: 554080 - DNA, 22 bp, Homo sapiens
ttgctggccccagaatgctgag

SEQ ID NO: 554081 - DNA, 22 bp, Homo sapiens
tcatgcccatcccggccatcta

SEQ ID NO: 554082 - DNA, 22 bp, Homo sapiens
tcctcagtttcattttgaccct

SEQ ID NO: 554083 - DNA, 22 bp, Homo sapiens
acttgtaggaagagaactgcaa

SEQ ID NO: 554084 - DNA, 22 bp, Homo sapiens
tccacagccttttgtgaaattt

SEQ ID NO: 554085 - DNA, 22 bp, Homo sapiens
gagttttcattatattcccaac

SEQ ID NO: 554086 - DNA, 22 bp, Homo sapiens
tggggggcagaagcctaaggct

SEQ ID NO: 554087 - DNA, 22 bp, Homo sapiens
cccgagctgggcaggcctgggc

SEQ ID NO: 554088 - DNA, 22 bp, Homo sapiens
agatgtttggcatcaggcagac

SEQ ID NO: 554089 - DNA, 22 bp, Homo sapiens
tcccagcaggcaccgcttctgc

SEQ ID NO: 554090 - DNA, 22 bp, Homo sapiens
gtaatgaccacaaaactataca

SEQ ID NO: 554091 - DNA, 22 bp, Homo sapiens
tccttggttgattttctggggc

SEQ ID NO: 554092 - DNA, 22 bp, Homo sapiens
ttcactagtagttctcctttag

SEQ ID NO: 554093 - DNA, 22 bp, Homo sapiens
ccggaagattatttcattggca

SEQ ID NO: 554094 - DNA, 22 bp, Homo sapiens
gggaatctcagtggctgaaact

SEQ ID NO: 554095 - DNA, 22 bp, Homo sapiens
tgggtgggagagctttcctgga

SEQ ID NO: 554096 - DNA, 22 bp, Homo sapiens
tttctgcttaggaaaatatctg

SEQ ID NO: 554097 - DNA, 22 bp, Homo sapiens
ttgtaatcacccctttttttat

SEQ ID NO: 554098 - DNA, 22 bp, Homo sapiens
ttgctgtagggtgactccaagc

SEQ ID NO: 554099 - DNA, 22 bp, Homo sapiens
gctaaacaatagtacttgacat

SEQ ID NO: 554100 - DNA, 22 bp, Homo sapiens
acacaactagactgtgagcttc

SEQ ID NO: 554101 - DNA, 22 bp, Homo sapiens
ctctgagtccacctgatgggcc

SEQ ID NO: 554102 - DNA, 22 bp, Homo sapiens
ctgaaggttcatgatgtgatcc

SEQ ID NO: 554103 - DNA, 22 bp, Homo sapiens
tggggaactccacgtcttggga

SEQ ID NO: 554104 - DNA, 22 bp, Homo sapiens
agaccagggactgtccaagctg

SEQ ID NO: 554105 - DNA, 22 bp, Homo sapiens
tggacaggcagattaggattag

SEQ ID NO: 554106 - DNA, 22 bp, Homo sapiens
tcctaggatggtgcctggcact

SEQ ID NO: 554107 - DNA, 22 bp, Homo sapiens
gcatcctgccgtggcgctctca

SEQ ID NO: 554108 - DNA, 22 bp, Homo sapiens
tctcctcaccctgcctcagctg

SEQ ID NO: 554109 - DNA, 22 bp, Homo sapiens
gccctcccccctcttctttgga

SEQ ID NO: 554110 - DNA, 22 bp, Homo sapiens
tgcagagggagagagcgttacc

SEQ ID NO: 554111 - DNA, 22 bp, Homo sapiens
gtggggttctttagggtctctt

SEQ ID NO: 554112 - DNA, 22 bp, Homo sapiens
ttgtctgcaggaggtgaagtga

SEQ ID NO: 554113 - DNA, 22 bp, Homo sapiens
tgtgtttttctttttctctttg

SEQ ID NO: 554114 - DNA, 22 bp, Homo sapiens
tgagcattaggtgtgtttcaga

SEQ ID NO: 554115 - DNA, 22 bp, Homo sapiens
ccgcggcggccgagctgagtgt

SEQ ID NO: 554116 - DNA, 22 bp, Homo sapiens
attcatcaagacacaaatatac

SEQ ID NO: 554117 - DNA, 22 bp, Homo sapiens
acaaatgtattctgtccaagtg

SEQ ID NO: 554118 - DNA, 22 bp, Homo sapiens
tgcaggttgtcctcagtttcag

SEQ ID NO: 554119 - DNA, 22 bp, Homo sapiens
agctgggtttgggatttggtga

SEQ ID NO: 554120 - DNA, 22 bp, Homo sapiens
gattgctctctcgtttcttaat

SEQ ID NO: 554121 - DNA, 22 bp, Homo sapiens
ctacatgatttgttcccacaca

SEQ ID NO: 554122 - DNA, 22 bp, Homo sapiens
tattctccagtcaagtttgcat

SEQ ID NO: 554123 - DNA, 22 bp, Homo sapiens
catgggccctattcctgcctcc

SEQ ID NO: 554124 - DNA, 22 bp, Homo sapiens
tcaccaagctctcttcccggct

SEQ ID NO: 554125 - DNA, 22 bp, Homo sapiens
agggctggtctgaggggatgtt

SEQ ID NO: 554126 - DNA, 22 bp, Homo sapiens
cttcaagctctgagggaaaggg

SEQ ID NO: 554127 - DNA, 22 bp, Homo sapiens
aaggcaggcctggacaccctgt

SEQ ID NO: 554128 - DNA, 22 bp, Homo sapiens
agatggaggaagctgcttcttt

SEQ ID NO: 554129 - DNA, 22 bp, Homo sapiens
gggatggtagaccggtgacgtg

SEQ ID NO: 554130 - DNA, 22 bp, Homo sapiens
acagtttcttttcttttgtcgt

SEQ ID NO: 554131 - DNA, 22 bp, Homo sapiens
tgtgaagctggccatggctcag

SEQ ID NO: 554132 - DNA, 22 bp, Homo sapiens
ccaggctgcaccctgctttcct

SEQ ID NO: 554133 - DNA, 22 bp, Homo sapiens
ttaatgaccagctgggaggaac

SEQ ID NO: 554134 - DNA, 22 bp, Homo sapiens
gttgagtgaatcccatgttgct

SEQ ID NO: 554135 - DNA, 22 bp, Homo sapiens
gggaggacagaggtatgagttg

SEQ ID NO: 554136 - DNA, 22 bp, Homo sapiens
gactggaggaggcatggagggt

SEQ ID NO: 554137 - DNA, 22 bp, Homo sapiens
gctggtgctttgtggggtctcc

SEQ ID NO: 554138 - DNA, 22 bp, Homo sapiens
agacagtgtctcagaggccatc

SEQ ID NO: 554139 - DNA, 22 bp, Homo sapiens
ttgttttatttgaggaacagac

SEQ ID NO: 554140 - DNA, 22 bp, Homo sapiens
tgcaggatgagtgaaaaggcat

SEQ ID NO: 554141 - DNA, 22 bp, Homo sapiens
tggggttctgcccggcagggct

SEQ ID NO: 554142 - DNA, 22 bp, Homo sapiens
tccgatcagatttccagtgagt

SEQ ID NO: 554143 - DNA, 22 bp, Homo sapiens
tcgggtgcgggacagaggttgg

SEQ ID NO: 554144 - DNA, 22 bp, Homo sapiens
acaaggcacatgtgtcctgatc

SEQ ID NO: 554145 - DNA, 22 bp, Homo sapiens
tggcctggtggtgattctccag

SEQ ID NO: 554146 - DNA, 22 bp, Homo sapiens
ctcagcctcctgacaggacact

SEQ ID NO: 554147 - DNA, 22 bp, Homo sapiens
ttttgtcagttcggctcaagga

SEQ ID NO: 554148 - DNA, 22 bp, Homo sapiens
tccctaccatctttagttctct

SEQ ID NO: 554149 - DNA, 22 bp, Homo sapiens
ttggtttttggtcaccttggaa

SEQ ID NO: 554150 - DNA, 22 bp, Homo sapiens
cctaaaacaagtgcaagactag

SEQ ID NO: 554151 - DNA, 22 bp, Homo sapiens
tcacctgatttccacccacctg

SEQ ID NO: 554152 - DNA, 22 bp, Homo sapiens
aacgtctttgcagccagtaaag

SEQ ID NO: 554153 - DNA, 22 bp, Homo sapiens
attttgctgatctctttgcctc

SEQ ID NO: 554154 - DNA, 22 bp, Homo sapiens
tgcaggagcaggtgggaccccc

SEQ ID NO: 554155 - DNA, 22 bp, Homo sapiens
tttaacagggagaaaatctaat

SEQ ID NO: 554156 - DNA, 22 bp, Homo sapiens
tctgccagcttgctcctcccca

SEQ ID NO: 554157 - DNA, 22 bp, Homo sapiens
gggcacagcccctgagtctccc

SEQ ID NO: 554158 - DNA, 22 bp, Homo sapiens
tgcatgtgtaaatcttcctcct

SEQ ID NO: 554159 - DNA, 22 bp, Homo sapiens
actgaagctaaatggatattgt

SEQ ID NO: 554160 - DNA, 22 bp, Homo sapiens
tgaggtgtgggtggttggtttc

SEQ ID NO: 554161 - DNA, 22 bp, Homo sapiens
tctttggtatatctggctaggt

SEQ ID NO: 554162 - DNA, 22 bp, Homo sapiens
cagctgggaaggctgggtcagg

SEQ ID NO: 554163 - DNA, 22 bp, Homo sapiens
ctgcagcgatgctgtttctttc

SEQ ID NO: 554164 - DNA, 22 bp, Homo sapiens
catcttatagcttaggaggctg

SEQ ID NO: 554165 - DNA, 22 bp, Homo sapiens
ggtggggtgcagagatgggggt

SEQ ID NO: 554166 - DNA, 22 bp, Homo sapiens
gggttagggtgaaaggtataaa

SEQ ID NO: 554167 - DNA, 22 bp, Homo sapiens
acagctcagctatgtctgcatc

SEQ ID NO: 554168 - DNA, 22 bp, Homo sapiens
ctgggccactagctttaaactt

SEQ ID NO: 554169 - DNA, 22 bp, Homo sapiens
gtgcccttttttggaggaggct

SEQ ID NO: 554170 - DNA, 22 bp, Homo sapiens
ggtgtggagtgtgactgtgttg

SEQ ID NO: 554171 - DNA, 22 bp, Homo sapiens
tattttcttctatcttgatttc

SEQ ID NO: 554172 - DNA, 22 bp, Homo sapiens
tttctattcctgtgggctttct

SEQ ID NO: 554173 - DNA, 22 bp, Homo sapiens
ccttttgcctgggtctagagat

SEQ ID NO: 554174 - DNA, 22 bp, Homo sapiens
tagtcatagatacccaaggtca

SEQ ID NO: 554175 - DNA, 22 bp, Homo sapiens
tagctgtgagtcatgggtgtga

SEQ ID NO: 554176 - DNA, 22 bp, Homo sapiens
ccggggttggcgcaggggcctc

SEQ ID NO: 554177 - DNA, 22 bp, Homo sapiens
tgcttagcagtgctaggaagga

SEQ ID NO: 554178 - DNA, 22 bp, Homo sapiens
tgcttaaagaatggctgtccgt

SEQ ID NO: 554179 - DNA, 22 bp, Homo sapiens
caggccctgggggagatggagg

SEQ ID NO: 554180 - DNA, 22 bp, Homo sapiens
catactcttagagactggggtc

SEQ ID NO: 554181 - DNA, 22 bp, Homo sapiens
tggcctatcatctgacatacag

SEQ ID NO: 554182 - DNA, 22 bp, Homo sapiens
tgaaagcttattttctcctagg

SEQ ID NO: 554183 - DNA, 22 bp, Homo sapiens
attggttgcgtaatttgatttg

SEQ ID NO: 554184 - DNA, 22 bp, Homo sapiens
atctcttcctcctacccccaag

SEQ ID NO: 554185 - DNA, 22 bp, Homo sapiens
cactcctgagtcctggccctcc

SEQ ID NO: 554186 - DNA, 22 bp, Homo sapiens
ttcctctttctctgctcttaac

SEQ ID NO: 554187 - DNA, 22 bp, Homo sapiens
tattctgatatcagcactttgg

SEQ ID NO: 554188 - DNA, 22 bp, Homo sapiens
tcagtaaatgtttattagatga

SEQ ID NO: 554189 - DNA, 22 bp, Homo sapiens
gaatgtctgtgcagccttggaa

SEQ ID NO: 554190 - DNA, 22 bp, Homo sapiens
ccagccccatccagaccagtgg

SEQ ID NO: 554191 - DNA, 22 bp, Homo sapiens
tgctttctagcaggtagatgtt

SEQ ID NO: 554192 - DNA, 22 bp, Homo sapiens
actctggtttggggatggcatg

SEQ ID NO: 554193 - DNA, 22 bp, Homo sapiens
tttatgagtgagaagagaccta

SEQ ID NO: 554194 - DNA, 22 bp, Homo sapiens
gatcccctagaccatcccccac

SEQ ID NO: 554195 - DNA, 22 bp, Homo sapiens
tcttagctccccctggcaggac

SEQ ID NO: 554196 - DNA, 22 bp, Homo sapiens
gccagatgcagaaaccaaagag

SEQ ID NO: 554197 - DNA, 22 bp, Homo sapiens
tcaggacccagtgagagaagga

SEQ ID NO: 554198 - DNA, 22 bp, Homo sapiens
agatgaggtgaggtggggaggg

SEQ ID NO: 554199 - DNA, 22 bp, Homo sapiens
tgcaggggtcctccccacgctg

SEQ ID NO: 554200 - DNA, 22 bp, Homo sapiens
ttaatgaactcttctagggcac

SEQ ID NO: 554201 - DNA, 22 bp, Homo sapiens
tcctggcccccaacccagcagc

SEQ ID NO: 554202 - DNA, 22 bp, Homo sapiens
catttttcctgtcttgctgact

SEQ ID NO: 554203 - DNA, 22 bp, Homo sapiens
tgttcccagagtctgtttcttc

SEQ ID NO: 554204 - DNA, 22 bp, Homo sapiens
ggggtgaaaataaagactgact

SEQ ID NO: 554205 - DNA, 22 bp, Homo sapiens
tcctcctctcccccagcttctc

SEQ ID NO: 554206 - DNA, 22 bp, Homo sapiens
tttggctccagctctgggcgcg

SEQ ID NO: 554207 - DNA, 22 bp, Homo sapiens
gaggcagtctgggccctgccca

SEQ ID NO: 554208 - DNA, 22 bp, Homo sapiens
agagcccccattgtgcctgccc

SEQ ID NO: 554209 - DNA, 22 bp, Homo sapiens
tctctttgaaggtcggctgcca

SEQ ID NO: 554210 - DNA, 22 bp, Homo sapiens
actttgggaaatcaaattcaaa

SEQ ID NO: 554211 - DNA, 22 bp, Homo sapiens
aggttcttcttctgtaaaatga

SEQ ID NO: 554212 - DNA, 22 bp, Homo sapiens
gagggattggtggtggttgttg

SEQ ID NO: 554213 - DNA, 22 bp, Homo sapiens
agttccagaaatgttaatatca

SEQ ID NO: 554214 - DNA, 22 bp, Homo sapiens
ggacacaggcggtggtctgggc

SEQ ID NO: 554215 - DNA, 22 bp, Homo sapiens
taggtgaattctagggtcaata

SEQ ID NO: 554216 - DNA, 22 bp, Homo sapiens
tgcagtccatgggcatatacac

SEQ ID NO: 554217 - DNA, 22 bp, Homo sapiens
ccctcccccactccctccagcc

SEQ ID NO: 554218 - DNA, 22 bp, Homo sapiens
tctcatctaagtgctggcatat

SEQ ID NO: 554219 - DNA, 22 bp, Homo sapiens
taatttctcagtctctctcata

SEQ ID NO: 554220 - DNA, 22 bp, Homo sapiens
ggtgtgatctgatttgaagggt

SEQ ID NO: 554221 - DNA, 22 bp, Homo sapiens
cggggggctgcggccgcccggc

SEQ ID NO: 554222 - DNA, 22 bp, Homo sapiens
ttctcctggagggtagtttttt

SEQ ID NO: 554223 - DNA, 22 bp, Homo sapiens
gcacggcttgagatattgtcag

SEQ ID NO: 554224 - DNA, 22 bp, Homo sapiens
ttgattggagtgaggggatacc

SEQ ID NO: 554225 - DNA, 22 bp, Homo sapiens
aaatgcattgagagtgttggtt

SEQ ID NO: 554226 - DNA, 22 bp, Homo sapiens
tcaggtgctcaaaaggtgctta

SEQ ID NO: 554227 - DNA, 22 bp, Homo sapiens
tggtcagagtgcatctgcgcaa

SEQ ID NO: 554228 - DNA, 22 bp, Homo sapiens
tggggtgggctgtccgatggtg

SEQ ID NO: 554229 - DNA, 22 bp, Homo sapiens
cccttacgcacgtggatttccc

SEQ ID NO: 554230 - DNA, 22 bp, Homo sapiens
gtgtccatagaagctttggggc

SEQ ID NO: 554231 - DNA, 22 bp, Homo sapiens
tcattcactttgtccccaccca

SEQ ID NO: 554232 - DNA, 22 bp, Homo sapiens
cctcaggctgctccaagccctg

SEQ ID NO: 554233 - DNA, 22 bp, Homo sapiens
agggagaccaaccttgcagata

SEQ ID NO: 554234 - DNA, 22 bp, Homo sapiens
gtgaagatcaacttccgcttca

SEQ ID NO: 554235 - DNA, 22 bp, Homo sapiens
tagaccttaaaaatctgtcata

SEQ ID NO: 554236 - DNA, 22 bp, Homo sapiens
ttctgctccagatgccaggggt

SEQ ID NO: 554237 - DNA, 22 bp, Homo sapiens
ctctgttgtgataaattggctg

SEQ ID NO: 554238 - DNA, 22 bp, Homo sapiens
taccaatgaggctgacagatgg

SEQ ID NO: 554239 - DNA, 22 bp, Homo sapiens
tttttggcagacaccaaagcat

SEQ ID NO: 554240 - DNA, 22 bp, Homo sapiens
aggatggagggtcacaccccga

SEQ ID NO: 554241 - DNA, 22 bp, Homo sapiens
tatacacctgctatgtgtgtgg

SEQ ID NO: 554242 - DNA, 22 bp, Homo sapiens
ttgttcatgtcacctctttccc

SEQ ID NO: 554243 - DNA, 22 bp, Homo sapiens
tgagggtggggctggctcagtg

SEQ ID NO: 554244 - DNA, 22 bp, Homo sapiens
tggaatttgggtgcagcctcct

SEQ ID NO: 554245 - DNA, 22 bp, Homo sapiens
ccccggctttacttcccactct

SEQ ID NO: 554246 - DNA, 22 bp, Homo sapiens
tggctacctggctgaaataaat

SEQ ID NO: 554247 - DNA, 22 bp, Homo sapiens
gtgattaaaccagatgtgttga

SEQ ID NO: 554248 - DNA, 22 bp, Homo sapiens
taggaataaattgaggtggatc

SEQ ID NO: 554249 - DNA, 22 bp, Homo sapiens
tggcagacagtgataatttctt

SEQ ID NO: 554250 - DNA, 22 bp, Homo sapiens
aggtggagcagtgttgggtgaa

SEQ ID NO: 554251 - DNA, 22 bp, Homo sapiens
agtgaaaaaaatttggagggga

SEQ ID NO: 554252 - DNA, 22 bp, Homo sapiens
acattcctgcctccccggagat

SEQ ID NO: 554253 - DNA, 22 bp, Homo sapiens
gtctggctcagggcagtcctct

SEQ ID NO: 554254 - DNA, 22 bp, Homo sapiens
tgttagtcatggatgttgccac

SEQ ID NO: 554255 - DNA, 22 bp, Homo sapiens
tgcattcccagctttcaccact

SEQ ID NO: 554256 - DNA, 22 bp, Homo sapiens
agctaacattgctgaagtgctc

SEQ ID NO: 554257 - DNA, 22 bp, Homo sapiens
ttcacggtttcttctcagggtg

SEQ ID NO: 554258 - DNA, 22 bp, Homo sapiens
tacacagggccggatcttgcca

SEQ ID NO: 554259 - DNA, 22 bp, Homo sapiens
gtgggaacgttactctgcttct

SEQ ID NO: 554260 - DNA, 22 bp, Homo sapiens
aagtggtgatggatttgcaata

SEQ ID NO: 554261 - DNA, 22 bp, Homo sapiens
taatggccagctgggagagttg

SEQ ID NO: 554262 - DNA, 22 bp, Homo sapiens
cagctttcacgatttggaacag

SEQ ID NO: 554263 - DNA, 22 bp, Homo sapiens
tgcctcttcctcctgtagcact

SEQ ID NO: 554264 - DNA, 22 bp, Homo sapiens
aggaagtgggtgctttagaggt

SEQ ID NO: 554265 - DNA, 22 bp, Homo sapiens
aatggacaggtctgtgaggagt

SEQ ID NO: 554266 - DNA, 22 bp, Homo sapiens
cccctgcagagttccttcaccc

SEQ ID NO: 554267 - DNA, 22 bp, Homo sapiens
tctgtcaaatatcatgctcttt

SEQ ID NO: 554268 - DNA, 22 bp, Homo sapiens
gtcacttcacagtcacaccaca

SEQ ID NO: 554269 - DNA, 22 bp, Homo sapiens
tgaatcccgagacggggggatg

SEQ ID NO: 554270 - DNA, 22 bp, Homo sapiens
tgcagggatggaaattagtggg

SEQ ID NO: 554271 - DNA, 22 bp, Homo sapiens
tcaggaacccaggtgagggtgg

SEQ ID NO: 554272 - DNA, 22 bp, Homo sapiens
taaggaaatttacctacaagag

SEQ ID NO: 554273 - DNA, 22 bp, Homo sapiens
cccagagtcttggtctgtttgc

SEQ ID NO: 554274 - DNA, 22 bp, Homo sapiens
cactggaccaagagtcagaaga

SEQ ID NO: 554275 - DNA, 22 bp, Homo sapiens
tagctgccaagggaactaaaag

SEQ ID NO: 554276 - DNA, 22 bp, Homo sapiens
cctggtcaaacttcaagcttcc

SEQ ID NO: 554277 - DNA, 22 bp, Homo sapiens
tctgtcctcggctgctgcactc

SEQ ID NO: 554278 - DNA, 22 bp, Homo sapiens
tgcagtctcttttgtgtagcat

SEQ ID NO: 554279 - DNA, 22 bp, Homo sapiens
ggtggcagtaggatctacccga

SEQ ID NO: 554280 - DNA, 22 bp, Homo sapiens
tcagactggcctctcactggtg

SEQ ID NO: 554281 - DNA, 22 bp, Homo sapiens
ttttcagcttccttccctccct

SEQ ID NO: 554282 - DNA, 22 bp, Homo sapiens
gatggcaagcctgagtaactgc

SEQ ID NO: 554283 - DNA, 22 bp, Homo sapiens
tgagtctttctgatcccattcc

SEQ ID NO: 554284 - DNA, 22 bp, Homo sapiens
tcttcttcctttgcagagttga

SEQ ID NO: 554285 - DNA, 22 bp, Homo sapiens
tggccctgagtgcccctcggcc

SEQ ID NO: 554286 - DNA, 22 bp, Homo sapiens
taaaatgctcttctgtcattgt

SEQ ID NO: 554287 - DNA, 22 bp, Homo sapiens
tggagcttggatgtgaagcagg

SEQ ID NO: 554288 - DNA, 22 bp, Homo sapiens
tgtaattttatgtataagctag

SEQ ID NO: 554289 - DNA, 22 bp, Homo sapiens
tgtatgccaacgcttagagtaa

SEQ ID NO: 554290 - DNA, 22 bp, Homo sapiens
cctggattcacatcccttactg

SEQ ID NO: 554291 - DNA, 22 bp, Homo sapiens
cctgaccggggtccccctccag

SEQ ID NO: 554292 - DNA, 22 bp, Homo sapiens
gcagtctgagttttgaaaggct

SEQ ID NO: 554293 - DNA, 22 bp, Homo sapiens
aaactgaaattcaggtataatc

SEQ ID NO: 554294 - DNA, 22 bp, Homo sapiens
gctttgcctggagtttctggtt

SEQ ID NO: 554295 - DNA, 22 bp, Homo sapiens
gtcttagccctgaacctctcac

SEQ ID NO: 554296 - DNA, 22 bp, Homo sapiens
tggtacttcatgttagttgagg

SEQ ID NO: 554297 - DNA, 22 bp, Homo sapiens
aaagacagatgatttcttggag

SEQ ID NO: 554298 - DNA, 22 bp, Homo sapiens
ttttttcaagctactactaaag

SEQ ID NO: 554299 - DNA, 22 bp, Homo sapiens
ctgtgacccctctgtctttgca

SEQ ID NO: 554300 - DNA, 22 bp, Homo sapiens
aggtgggggtgagaaaacagac

SEQ ID NO: 554301 - DNA, 22 bp, Homo sapiens
acaagccagttgtcgtgtatga

SEQ ID NO: 554302 - DNA, 22 bp, Homo sapiens
gccccagctttccccacttgtc

SEQ ID NO: 554303 - DNA, 22 bp, Homo sapiens
ctgtggaatgttacggattgca

SEQ ID NO: 554304 - DNA, 22 bp, Homo sapiens
gacagtttgcaagcgtgattca

SEQ ID NO: 554305 - DNA, 22 bp, Homo sapiens
tggtcaccagaagcatctctcc

SEQ ID NO: 554306 - DNA, 22 bp, Homo sapiens
tgcggggtccggtgcagctcat

SEQ ID NO: 554307 - DNA, 22 bp, Homo sapiens
tgctggtgggcataggtgccag

SEQ ID NO: 554308 - DNA, 22 bp, Homo sapiens
ggggagagctgtgcggggcttg

SEQ ID NO: 554309 - DNA, 22 bp, Homo sapiens
tcttgttgccactgcctggcct

SEQ ID NO: 554310 - DNA, 22 bp, Homo sapiens
tcaattcaacttgacaaacatt

SEQ ID NO: 554311 - DNA, 22 bp, Homo sapiens
tgaatggcaggagggttgcgca

SEQ ID NO: 554312 - DNA, 22 bp, Homo sapiens
ctggaaagtatggagttgttac

SEQ ID NO: 554313 - DNA, 22 bp, Homo sapiens
aaatgaggttgcaggggaaggg

SEQ ID NO: 554314 - DNA, 22 bp, Homo sapiens
tgtccatggattttgtgtagaa

SEQ ID NO: 554315 - DNA, 22 bp, Homo sapiens
tgagtgacatttgcaccagctg

SEQ ID NO: 554316 - DNA, 22 bp, Homo sapiens
tcctctccacctcctgttgcca

SEQ ID NO: 554317 - DNA, 22 bp, Homo sapiens
tctgagatggatgacatgtatc

SEQ ID NO: 554318 - DNA, 22 bp, Homo sapiens
tatgggagactaggttgtgatt

SEQ ID NO: 554319 - DNA, 22 bp, Homo sapiens
tcaccccctagacctttaggcc

SEQ ID NO: 554320 - DNA, 22 bp, Homo sapiens
ttggtttgttagttaatggccc

SEQ ID NO: 554321 - DNA, 22 bp, Homo sapiens
gagggcaaggactggagtctca

SEQ ID NO: 554322 - DNA, 22 bp, Homo sapiens
tgagtcatacaggagaaaaaca

SEQ ID NO: 554323 - DNA, 22 bp, Homo sapiens
agctgattgggaatggaagcag

SEQ ID NO: 554324 - DNA, 22 bp, Homo sapiens
ttgtttggagtagtttatcctc

SEQ ID NO: 554325 - DNA, 22 bp, Homo sapiens
attttttatttccttaaaattg

SEQ ID NO: 554326 - DNA, 22 bp, Homo sapiens
agttctgctgcctgatgattcc

SEQ ID NO: 554327 - DNA, 22 bp, Homo sapiens
ttttggggaagtttgggatctg

SEQ ID NO: 554328 - DNA, 22 bp, Homo sapiens
tcagagggcaaggaagcaaaga

SEQ ID NO: 554329 - DNA, 22 bp, Homo sapiens
caggattttagtaattgaaact

SEQ ID NO: 554330 - DNA, 22 bp, Homo sapiens
aatcctttgtccctgggtgaga

SEQ ID NO: 554331 - DNA, 22 bp, Homo sapiens
tcctgttgcatctgtcatatat

SEQ ID NO: 554332 - DNA, 22 bp, Homo sapiens
gtatgtagtgcaatcagtcagg

SEQ ID NO: 554333 - DNA, 22 bp, Homo sapiens
tggctctgaagcttcttcctta

SEQ ID NO: 554334 - DNA, 22 bp, Homo sapiens
tttattggcatcttaaaatagg

SEQ ID NO: 554335 - DNA, 22 bp, Homo sapiens
ggaagagctgggtgcgagtggg

SEQ ID NO: 554336 - DNA, 22 bp, Homo sapiens
taactaggatgttggggaattg

SEQ ID NO: 554337 - DNA, 22 bp, Homo sapiens
gcagaatgttaataagctgtgt

SEQ ID NO: 554338 - DNA, 22 bp, Homo sapiens
ttgctgaaaaagaaatataaaa

SEQ ID NO: 554339 - DNA, 22 bp, Homo sapiens
cactgtgcctgttgtaatcccc

SEQ ID NO: 554340 - DNA, 22 bp, Homo sapiens
ttgaccacaaagaaaagaatta

SEQ ID NO: 554341 - DNA, 22 bp, Homo sapiens
tgggaggaggtaggaaagctaa

SEQ ID NO: 554342 - DNA, 22 bp, Homo sapiens
agaagaatgatgttgggctgcc

SEQ ID NO: 554343 - DNA, 22 bp, Homo sapiens
tttgtgccatttatccctctag

SEQ ID NO: 554344 - DNA, 22 bp, Homo sapiens
gtgttttgaattctttttctct

SEQ ID NO: 554345 - DNA, 22 bp, Homo sapiens
catggcagggtgggagaggcgg

SEQ ID NO: 554346 - DNA, 22 bp, Homo sapiens
agagggaatggacttagctgtg

SEQ ID NO: 554347 - DNA, 22 bp, Homo sapiens
tcacaaggaacttctcctcttg

SEQ ID NO: 554348 - DNA, 22 bp, Homo sapiens
cagcatcagggtctgccttgcg

SEQ ID NO: 554349 - DNA, 22 bp, Homo sapiens
cagctctcattatgacatttag

SEQ ID NO: 554350 - DNA, 22 bp, Homo sapiens
tcctcttttgccctcccccatc

SEQ ID NO: 554351 - DNA, 22 bp, Homo sapiens
ggaagagaggagcagttgctac

SEQ ID NO: 554352 - DNA, 22 bp, Homo sapiens
ttttctttcagttctttccaaa

SEQ ID NO: 554353 - DNA, 22 bp, Homo sapiens
ccctttcctgcagctcttgtct

SEQ ID NO: 554354 - DNA, 22 bp, Homo sapiens
tgaggcgtcgggagggaggagg

SEQ ID NO: 554355 - DNA, 22 bp, Homo sapiens
agcttccttccatgctgtcact

SEQ ID NO: 554356 - DNA, 22 bp, Homo sapiens
tgcagctgctcttcctctattg

SEQ ID NO: 554357 - DNA, 22 bp, Homo sapiens
tgcagaggggacagtgggagtc

SEQ ID NO: 554358 - DNA, 22 bp, Homo sapiens
ctgctgggctggtccttctgag

SEQ ID NO: 554359 - DNA, 22 bp, Homo sapiens
tactgcaggggatgctctgcct

SEQ ID NO: 554360 - DNA, 22 bp, Homo sapiens
ttcttatattccagaggccact

SEQ ID NO: 554361 - DNA, 22 bp, Homo sapiens
gcaggaggagaagtggggggat

SEQ ID NO: 554362 - DNA, 22 bp, Homo sapiens
cctgggtctgggctttaggcca

SEQ ID NO: 554363 - DNA, 22 bp, Homo sapiens
ttttgggatgagtggggagcaa

SEQ ID NO: 554364 - DNA, 22 bp, Homo sapiens
gactgctgttggaatggaaaat

SEQ ID NO: 554365 - DNA, 22 bp, Homo sapiens
ttcagcccttccctgttttcat

SEQ ID NO: 554366 - DNA, 22 bp, Homo sapiens
tggtgagctttggccaacaggc

SEQ ID NO: 554367 - DNA, 22 bp, Homo sapiens
tgggagtgagggaggaaagggg

SEQ ID NO: 554368 - DNA, 22 bp, Homo sapiens
ttcacagcagtccatagaggct

SEQ ID NO: 554369 - DNA, 22 bp, Homo sapiens
agaggggaaggagtggtgtctt

SEQ ID NO: 554370 - DNA, 22 bp, Homo sapiens
cgatgtggcccacctgaggtcc

SEQ ID NO: 554371 - DNA, 22 bp, Homo sapiens
agcagccagtttgattgtgttg

SEQ ID NO: 554372 - DNA, 22 bp, Homo sapiens
gttgccatggtgacaaaatctt

SEQ ID NO: 554373 - DNA, 22 bp, Homo sapiens
ttttctatagctatgaccgtta

SEQ ID NO: 554374 - DNA, 22 bp, Homo sapiens
tcctgggccccctgccccaccc

SEQ ID NO: 554375 - DNA, 22 bp, Homo sapiens
gagttttacttacctaagaagc

SEQ ID NO: 554376 - DNA, 22 bp, Homo sapiens
ttctaagcattggtatacatta

SEQ ID NO: 554377 - DNA, 22 bp, Homo sapiens
caagagctgcaggaaagggctg

SEQ ID NO: 554378 - DNA, 22 bp, Homo sapiens
tggcacaggtagaatttctggg

SEQ ID NO: 554379 - DNA, 22 bp, Homo sapiens
ggggaggccaaggcctgggtgc

SEQ ID NO: 554380 - DNA, 22 bp, Homo sapiens
cacttatgactaaaagtaggca

SEQ ID NO: 554381 - DNA, 22 bp, Homo sapiens
ggagccagactgtttaggttca

SEQ ID NO: 554382 - DNA, 22 bp, Homo sapiens
cctcccggccagtgaccccgcc

SEQ ID NO: 554383 - DNA, 22 bp, Homo sapiens
tgccaatggctgcaaggggttg

SEQ ID NO: 554384 - DNA, 22 bp, Homo sapiens
tcatatgtgacacgtgattaca

SEQ ID NO: 554385 - DNA, 22 bp, Homo sapiens
cgggggtatcgctgtgggggag

SEQ ID NO: 554386 - DNA, 22 bp, Homo sapiens
ttacatgataattatacttaag

SEQ ID NO: 554387 - DNA, 22 bp, Homo sapiens
ttggtctttccttctccctact

SEQ ID NO: 554388 - DNA, 22 bp, Homo sapiens
ggaggtaggaaggagccctgca

SEQ ID NO: 554389 - DNA, 22 bp, Homo sapiens
tggggttccaacaattttcccg

SEQ ID NO: 554390 - DNA, 22 bp, Homo sapiens
ttttctgtttcagaaaggacag

SEQ ID NO: 554391 - DNA, 22 bp, Homo sapiens
tgtgctgggtgctctgctctca

SEQ ID NO: 554392 - DNA, 22 bp, Homo sapiens
gagatttaggagaagttctctg

SEQ ID NO: 554393 - DNA, 22 bp, Homo sapiens
tcctgtttctctgccatttaca

SEQ ID NO: 554394 - DNA, 22 bp, Homo sapiens
tagatcagaggaagaagtagtt

SEQ ID NO: 554395 - DNA, 22 bp, Homo sapiens
gctggggtggactcctgcctac

SEQ ID NO: 554396 - DNA, 22 bp, Homo sapiens
aacactgagatacacatctcat

SEQ ID NO: 554397 - DNA, 22 bp, Homo sapiens
aggatttgtgggcgcaattcat

SEQ ID NO: 554398 - DNA, 22 bp, Homo sapiens
tttatgttattctgataatgac

SEQ ID NO: 554399 - DNA, 22 bp, Homo sapiens
atttcagagtgtgatgcaaaag

SEQ ID NO: 554400 - DNA, 22 bp, Homo sapiens
gaaagatggctgcaccattttc

SEQ ID NO: 554401 - DNA, 22 bp, Homo sapiens
gggtcgccttgtctctttaccc

SEQ ID NO: 554402 - DNA, 22 bp, Homo sapiens
gctctggagtctgctgtcttgg

SEQ ID NO: 554403 - DNA, 22 bp, Homo sapiens
tctgcagtcagaggccaggagc

SEQ ID NO: 554404 - DNA, 22 bp, Homo sapiens
aggactctctgcagcccttcct

SEQ ID NO: 554405 - DNA, 22 bp, Homo sapiens
taaatcgtgatattgaccccat

SEQ ID NO: 554406 - DNA, 22 bp, Homo sapiens
gcaggcggcttagcagaggagg

SEQ ID NO: 554407 - DNA, 22 bp, Homo sapiens
gaaacattcgcggtgcacttct

SEQ ID NO: 554408 - DNA, 22 bp, Homo sapiens
taggtagggctaattagaaatt

SEQ ID NO: 554409 - DNA, 22 bp, Homo sapiens
agccatgcccgtgttcatgaaa

SEQ ID NO: 554410 - DNA, 22 bp, Homo sapiens
tccatcagtgtcaggaaggacc

SEQ ID NO: 554411 - DNA, 22 bp, Homo sapiens
gattgctcagggagcaggagga

SEQ ID NO: 554412 - DNA, 22 bp, Homo sapiens
gagatggggagagcccctgatg

SEQ ID NO: 554413 - DNA, 22 bp, Homo sapiens
gcctttggaggcctccagctgg

SEQ ID NO: 554414 - DNA, 22 bp, Homo sapiens
tcgtggtcctggcttcctcatc

SEQ ID NO: 554415 - DNA, 22 bp, Homo sapiens
cccagagtcacgtggttttttg

SEQ ID NO: 554416 - DNA, 22 bp, Homo sapiens
gggcctcagcatttccacagat

SEQ ID NO: 554417 - DNA, 22 bp, Homo sapiens
tggagaagtatgagccttcaca

SEQ ID NO: 554418 - DNA, 22 bp, Homo sapiens
caatgaacttattgtggtgttt

SEQ ID NO: 554419 - DNA, 22 bp, Homo sapiens
tgatgccatttatcttttgaag

SEQ ID NO: 554420 - DNA, 22 bp, Homo sapiens
tgcctctctggtctttgtccat

SEQ ID NO: 554421 - DNA, 22 bp, Homo sapiens
ttggtagtttggagccagatgt

SEQ ID NO: 554422 - DNA, 22 bp, Homo sapiens
tggggaggggggagcgaagcag

SEQ ID NO: 554423 - DNA, 22 bp, Homo sapiens
tgcagcaggctgccggagccgc

SEQ ID NO: 554424 - DNA, 22 bp, Homo sapiens
attctaattgggatgcctagct

SEQ ID NO: 554425 - DNA, 22 bp, Homo sapiens
gctaagctttgagacccgcttc

SEQ ID NO: 554426 - DNA, 22 bp, Homo sapiens
gatagttctgtagttctttctc

SEQ ID NO: 554427 - DNA, 22 bp, Homo sapiens
tcatcctctagtttttttcaag

SEQ ID NO: 554428 - DNA, 22 bp, Homo sapiens
tcataggtttcaaagctctggg

SEQ ID NO: 554429 - DNA, 22 bp, Homo sapiens
acctagggtaccaaagtagtgt

SEQ ID NO: 554430 - DNA, 22 bp, Homo sapiens
ctgagccgagtagggaggggac

SEQ ID NO: 554431 - DNA, 22 bp, Homo sapiens
gacagggggtgggagggggcat

SEQ ID NO: 554432 - DNA, 22 bp, Homo sapiens
tggagggagcccacattgggag

SEQ ID NO: 554433 - DNA, 22 bp, Homo sapiens
tcactgctgagtagaaatcttt

SEQ ID NO: 554434 - DNA, 22 bp, Homo sapiens
tggcccaaggaggaggaaaggg

SEQ ID NO: 554435 - DNA, 22 bp, Homo sapiens
tggtttgacctcttgatccctc

SEQ ID NO: 554436 - DNA, 22 bp, Homo sapiens
tttcctccctttccgtctctgc

SEQ ID NO: 554437 - DNA, 22 bp, Homo sapiens
tttggtcagggttatagcttag

SEQ ID NO: 554438 - DNA, 22 bp, Homo sapiens
aaatatgtaaaagcaacttagc

SEQ ID NO: 554439 - DNA, 22 bp, Homo sapiens
agagcctgcggctggcgtttga

SEQ ID NO: 554440 - DNA, 22 bp, Homo sapiens
tatgcctcatctataaaatggg

SEQ ID NO: 554441 - DNA, 22 bp, Homo sapiens
tcttgctgggacggaggggcag

SEQ ID NO: 554442 - DNA, 22 bp, Homo sapiens
ttcaggctgtctggatctacgc

SEQ ID NO: 554443 - DNA, 22 bp, Homo sapiens
actccaaggtacctgccagata

SEQ ID NO: 554444 - DNA, 22 bp, Homo sapiens
tcaaattacatttgaactctgt

SEQ ID NO: 554445 - DNA, 22 bp, Homo sapiens
aggggaaactgaggcagcccac

SEQ ID NO: 554446 - DNA, 22 bp, Homo sapiens
tgggaggcagcaagaggcagct

SEQ ID NO: 554447 - DNA, 22 bp, Homo sapiens
gccccttccagtccttctcgga

SEQ ID NO: 554448 - DNA, 22 bp, Homo sapiens
tctgctacaaaggagcagcatc

SEQ ID NO: 554449 - DNA, 22 bp, Homo sapiens
gactgattggagcgctctcgac

SEQ ID NO: 554450 - DNA, 22 bp, Homo sapiens
gtgaaatgccagccaaagcagg

SEQ ID NO: 554451 - DNA, 22 bp, Homo sapiens
tggagcatgcaaggcagggtgg

SEQ ID NO: 554452 - DNA, 22 bp, Homo sapiens
taatccctttgtgcctgtgggg

SEQ ID NO: 554453 - DNA, 22 bp, Homo sapiens
aagtttaaggttgggctttaaa

SEQ ID NO: 554454 - DNA, 22 bp, Homo sapiens
gaaggagttcaggcttccgggc

SEQ ID NO: 554455 - DNA, 22 bp, Homo sapiens
taagcactacagcagggcctca

SEQ ID NO: 554456 - DNA, 22 bp, Homo sapiens
tgggacaggggtgggggcacag

SEQ ID NO: 554457 - DNA, 22 bp, Homo sapiens
agacaggattatatgatctcca

SEQ ID NO: 554458 - DNA, 22 bp, Homo sapiens
tttagaattggctgagaattat

SEQ ID NO: 554459 - DNA, 22 bp, Homo sapiens
gatcagtgaaggaggaagctgg

SEQ ID NO: 554460 - DNA, 22 bp, Homo sapiens
tcttcctcatcctcatccagct

SEQ ID NO: 554461 - DNA, 22 bp, Homo sapiens
ttcagatggggtttgagtccta

SEQ ID NO: 554462 - DNA, 22 bp, Homo sapiens
gcgtgggtctcatttcccactg

SEQ ID NO: 554463 - DNA, 22 bp, Homo sapiens
tgctatggagaaatttgttacc

SEQ ID NO: 554464 - DNA, 22 bp, Homo sapiens
tggagttgggggattttatgca

SEQ ID NO: 554465 - DNA, 22 bp, Homo sapiens
gcttcccgcagtccccacgcgc

SEQ ID NO: 554466 - DNA, 22 bp, Homo sapiens
tctactcgggtggcgtgtcttg

SEQ ID NO: 554467 - DNA, 22 bp, Homo sapiens
cacagagcctggcacattattt

SEQ ID NO: 554468 - DNA, 22 bp, Homo sapiens
ccaggctgatgtagactggcag

SEQ ID NO: 554469 - DNA, 22 bp, Homo sapiens
aagttcttctcctgctaatcct

SEQ ID NO: 554470 - DNA, 22 bp, Homo sapiens
taatgtgcctaatgactgctag

SEQ ID NO: 554471 - DNA, 22 bp, Homo sapiens
tcattcattcatcaaatattca

SEQ ID NO: 554472 - DNA, 22 bp, Homo sapiens
tatggtttggatttgagtgatt

SEQ ID NO: 554473 - DNA, 22 bp, Homo sapiens
ctcccccctgcaaaacgttgct

SEQ ID NO: 554474 - DNA, 22 bp, Homo sapiens
tgccgccagcctcactcatcac

SEQ ID NO: 554475 - DNA, 22 bp, Homo sapiens
actgtactcttacagccatctg

SEQ ID NO: 554476 - DNA, 22 bp, Homo sapiens
tctgtaagcactcaaaaccaca

SEQ ID NO: 554477 - DNA, 22 bp, Homo sapiens
aggactgacattcctcgggtta

SEQ ID NO: 554478 - DNA, 22 bp, Homo sapiens
tggtgaccctgaggatgcacca

SEQ ID NO: 554479 - DNA, 22 bp, Homo sapiens
tgttgcacatatttggcatgta

SEQ ID NO: 554480 - DNA, 22 bp, Homo sapiens
actgttgtctagaccatgcctg

SEQ ID NO: 554481 - DNA, 22 bp, Homo sapiens
attagataaagcagattgtcat

SEQ ID NO: 554482 - DNA, 22 bp, Homo sapiens
tggggaggagggtgaagacaga

SEQ ID NO: 554483 - DNA, 22 bp, Homo sapiens
attaggcaagcttttcctggag

SEQ ID NO: 554484 - DNA, 22 bp, Homo sapiens
ttagggtgcttagctgttaact

SEQ ID NO: 554485 - DNA, 22 bp, Homo sapiens
ctacactcaaggcatggaggag

SEQ ID NO: 554486 - DNA, 22 bp, Homo sapiens
atgttgcattcctgctcaggtg

SEQ ID NO: 554487 - DNA, 22 bp, Homo sapiens
ctgctgggactcctgctctgcc

SEQ ID NO: 554488 - DNA, 22 bp, Homo sapiens
gtctgtcatcctgttcacctcc

SEQ ID NO: 554489 - DNA, 22 bp, Homo sapiens
gccacctgtgggagtaattagt

SEQ ID NO: 554490 - DNA, 22 bp, Homo sapiens
cagctctccttcaggggtgttt

SEQ ID NO: 554491 - DNA, 22 bp, Homo sapiens
gctgcagatcacaaaaatgaca

SEQ ID NO: 554492 - DNA, 22 bp, Homo sapiens
ccccaggggaggggtggtcggt

SEQ ID NO: 554493 - DNA, 22 bp, Homo sapiens
tctatcttggaggatgtttgtg

SEQ ID NO: 554494 - DNA, 22 bp, Homo sapiens
ccggagcctcagcttccttacc

SEQ ID NO: 554495 - DNA, 22 bp, Homo sapiens
tcctcatttctacagtcgctgc

SEQ ID NO: 554496 - DNA, 22 bp, Homo sapiens
cgtgcaggggaagtctggagaa

SEQ ID NO: 554497 - DNA, 22 bp, Homo sapiens
tggccatttcagttctctcctt

SEQ ID NO: 554498 - DNA, 22 bp, Homo sapiens
tgtgctgggtaattctgagagt

SEQ ID NO: 554499 - DNA, 22 bp, Homo sapiens
tgtgtctgtgtgcgtatctgtg

SEQ ID NO: 554500 - DNA, 22 bp, Homo sapiens
caaaactattttctttgctttt

SEQ ID NO: 554501 - DNA, 22 bp, Homo sapiens
caatcgaggaagacttcctggt

SEQ ID NO: 554502 - DNA, 22 bp, Homo sapiens
tctgtgggatgaaatgggagga

SEQ ID NO: 554503 - DNA, 22 bp, Homo sapiens
gacatgagggctctattttcag

SEQ ID NO: 554504 - DNA, 22 bp, Homo sapiens
tggccaggctcatgaggccaca

SEQ ID NO: 554505 - DNA, 22 bp, Homo sapiens
tgtgatgtttattttatcccat

SEQ ID NO: 554506 - DNA, 22 bp, Homo sapiens
ttttttattccactgttcatcc

SEQ ID NO: 554507 - DNA, 22 bp, Homo sapiens
tgctagttcatgtctttctgca

SEQ ID NO: 554508 - DNA, 22 bp, Homo sapiens
aggctggcagggggaggaaaaa

SEQ ID NO: 554509 - DNA, 22 bp, Homo sapiens
ctggcccaaggctttgggggct

SEQ ID NO: 554510 - DNA, 22 bp, Homo sapiens
aaccgcgcccccgctcagcctc

SEQ ID NO: 554511 - DNA, 22 bp, Homo sapiens
tgcctggcacatagcaggcact

SEQ ID NO: 554512 - DNA, 22 bp, Homo sapiens
agtgatgaacagtgtttgaggg

SEQ ID NO: 554513 - DNA, 22 bp, Homo sapiens
gccttttactaacactcttttc

SEQ ID NO: 554514 - DNA, 22 bp, Homo sapiens
atgaaagactgctggctttact

SEQ ID NO: 554515 - DNA, 22 bp, Homo sapiens
agtaaagccaatgtgattttct

SEQ ID NO: 554516 - DNA, 22 bp, Homo sapiens
gtcctcagtgagtgatcctgtg

SEQ ID NO: 554517 - DNA, 22 bp, Homo sapiens
acaaatgcgtctgtcctggctg

SEQ ID NO: 554518 - DNA, 22 bp, Homo sapiens
gcctcctttgtaaaatggagaa

SEQ ID NO: 554519 - DNA, 22 bp, Homo sapiens
tcctgtccctgtccctgcccct

SEQ ID NO: 554520 - DNA, 22 bp, Homo sapiens
aggcagggtgcaggagccttgg

SEQ ID NO: 554521 - DNA, 22 bp, Homo sapiens
tgctgtgcctttgtctgcctcc

SEQ ID NO: 554522 - DNA, 22 bp, Homo sapiens
taacctttggaagtccctgact

SEQ ID NO: 554523 - DNA, 22 bp, Homo sapiens
gggcattgttagacatgacatt

SEQ ID NO: 554524 - DNA, 22 bp, Homo sapiens
tttgtgccccgggtgccccacc

SEQ ID NO: 554525 - DNA, 22 bp, Homo sapiens
tgtggattaacaatgacggaaa

SEQ ID NO: 554526 - DNA, 22 bp, Homo sapiens
tactttggatgttcattctaaa

SEQ ID NO: 554527 - DNA, 22 bp, Homo sapiens
tcccttccaaacggtgctccct

SEQ ID NO: 554528 - DNA, 22 bp, Homo sapiens
cctggaacagggagcgtcagtt

SEQ ID NO: 554529 - DNA, 22 bp, Homo sapiens
atattctcacagtgacacaagc

SEQ ID NO: 554530 - DNA, 22 bp, Homo sapiens
gagtttggggcacaaatgtact

SEQ ID NO: 554531 - DNA, 22 bp, Homo sapiens
gcaccagaaaagggtccacatg

SEQ ID NO: 554532 - DNA, 22 bp, Homo sapiens
tgccaggtggggagaggccagg

SEQ ID NO: 554533 - DNA, 22 bp, Homo sapiens
tggtgatgcttttctgatttgt

SEQ ID NO: 554534 - DNA, 22 bp, Homo sapiens
tttattaaatacttactgagag

SEQ ID NO: 554535 - DNA, 22 bp, Homo sapiens
tcgtcatcctgaaatttcccat

SEQ ID NO: 554536 - DNA, 22 bp, Homo sapiens
taaaagaatttgcttatgtgct

SEQ ID NO: 554537 - DNA, 22 bp, Homo sapiens
tgagcaaggaggatataaatag

SEQ ID NO: 554538 - DNA, 22 bp, Homo sapiens
accactacttctgatagtgttt

SEQ ID NO: 554539 - DNA, 22 bp, Homo sapiens
accactggggtaccatttggta

SEQ ID NO: 554540 - DNA, 22 bp, Homo sapiens
tgacaggtacagggacaaatcc

SEQ ID NO: 554541 - DNA, 22 bp, Homo sapiens
tctgaattaaaccctttgtgcc

SEQ ID NO: 554542 - DNA, 22 bp, Homo sapiens
tggcattccaggatctgtgggt

SEQ ID NO: 554543 - DNA, 22 bp, Homo sapiens
cctcttctagcctcgtttgatt

SEQ ID NO: 554544 - DNA, 22 bp, Homo sapiens
tgcctctcctctgcccttccta

SEQ ID NO: 554545 - DNA, 22 bp, Homo sapiens
tcaatccttggtaatctggctg

SEQ ID NO: 554546 - DNA, 22 bp, Homo sapiens
gcccttctggaaccttctgcaa

SEQ ID NO: 554547 - DNA, 22 bp, Homo sapiens
agcttcccgggcagctgggcag

SEQ ID NO: 554548 - DNA, 22 bp, Homo sapiens
ggagggttttcttctttcctac

SEQ ID NO: 554549 - DNA, 22 bp, Homo sapiens
ctctggggtggctgtggaaatg

SEQ ID NO: 554550 - DNA, 22 bp, Homo sapiens
aaaattaactgggacagtgcag

SEQ ID NO: 554551 - DNA, 22 bp, Homo sapiens
gattctggggctaacaggagga

SEQ ID NO: 554552 - DNA, 22 bp, Homo sapiens
ttctattttctgcttctaaact

SEQ ID NO: 554553 - DNA, 22 bp, Homo sapiens
tcacggctgtgatggaaggaat

SEQ ID NO: 554554 - DNA, 22 bp, Homo sapiens
gcagtgaatatcaatgagagga

SEQ ID NO: 554555 - DNA, 22 bp, Homo sapiens
tctttgaactacagaaaccctg

SEQ ID NO: 554556 - DNA, 22 bp, Homo sapiens
tcaggtggccaggtgcatatct

SEQ ID NO: 554557 - DNA, 22 bp, Homo sapiens
gccaagattacttttgtgactg

SEQ ID NO: 554558 - DNA, 22 bp, Homo sapiens
ttcaggccaccggggtgctgtt

SEQ ID NO: 554559 - DNA, 22 bp, Homo sapiens
tcaagcccagaggaaaatggct

SEQ ID NO: 554560 - DNA, 22 bp, Homo sapiens
agcagcttcctttgtctccctc

SEQ ID NO: 554561 - DNA, 22 bp, Homo sapiens
cagaagtagctggaagagagag

SEQ ID NO: 554562 - DNA, 22 bp, Homo sapiens
agttatctgcgaaatgggagtc

SEQ ID NO: 554563 - DNA, 22 bp, Homo sapiens
aagagaccagattggaaggtct

SEQ ID NO: 554564 - DNA, 22 bp, Homo sapiens
gggttgggagggattgtactga

SEQ ID NO: 554565 - DNA, 22 bp, Homo sapiens
gcaatttaaaattactggagtg

SEQ ID NO: 554566 - DNA, 22 bp, Homo sapiens
aatctagttcatgtgtatataa

SEQ ID NO: 554567 - DNA, 22 bp, Homo sapiens
tactatacctattaccaaaggg

SEQ ID NO: 554568 - DNA, 22 bp, Homo sapiens
agtggcaggagatgggggtggg

SEQ ID NO: 554569 - DNA, 22 bp, Homo sapiens
gaagactgataacatatatgga

SEQ ID NO: 554570 - DNA, 22 bp, Homo sapiens
tgctcttttctcaatgtggtaa

SEQ ID NO: 554571 - DNA, 22 bp, Homo sapiens
ttccacagggtttcccgcacgc

SEQ ID NO: 554572 - DNA, 22 bp, Homo sapiens
ttcaaagcgctttcatgaatta

SEQ ID NO: 554573 - DNA, 22 bp, Homo sapiens
tgcattagacaaccaaataggg

SEQ ID NO: 554574 - DNA, 22 bp, Homo sapiens
agcctggagtactgagagatct

SEQ ID NO: 554575 - DNA, 22 bp, Homo sapiens
tacctgagggtccggggaacag

SEQ ID NO: 554576 - DNA, 22 bp, Homo sapiens
agggagagatggagttagatta

SEQ ID NO: 554577 - DNA, 22 bp, Homo sapiens
caggaaggaggtggttcacatt

SEQ ID NO: 554578 - DNA, 22 bp, Homo sapiens
ttaagattactgaaataaccag

SEQ ID NO: 554579 - DNA, 22 bp, Homo sapiens
tctgcataggtgctgaatctgt

SEQ ID NO: 554580 - DNA, 22 bp, Homo sapiens
ttcttgtcagcatttggtaggg

SEQ ID NO: 554581 - DNA, 22 bp, Homo sapiens
ggtcggtgcggacacggcggta

SEQ ID NO: 554582 - DNA, 22 bp, Homo sapiens
gggaggggctgaggcagtggga

SEQ ID NO: 554583 - DNA, 22 bp, Homo sapiens
cctctcacctcccttagtccct

SEQ ID NO: 554584 - DNA, 22 bp, Homo sapiens
tttgagttagtcaaaactttag

SEQ ID NO: 554585 - DNA, 22 bp, Homo sapiens
ggtggagaggagatggggtgca

SEQ ID NO: 554586 - DNA, 22 bp, Homo sapiens
acagaagttgtggcaaacttct

SEQ ID NO: 554587 - DNA, 22 bp, Homo sapiens
tgaaaggaaaagggttttgact

SEQ ID NO: 554588 - DNA, 22 bp, Homo sapiens
tagtttcctcccgcgtgggtgc

SEQ ID NO: 554589 - DNA, 22 bp, Homo sapiens
tctagggcagacctgggcattg

SEQ ID NO: 554590 - DNA, 22 bp, Homo sapiens
tcaagctgacagctatgagcaa

SEQ ID NO: 554591 - DNA, 22 bp, Homo sapiens
ctggaccccgcgcagtgctctc

SEQ ID NO: 554592 - DNA, 22 bp, Homo sapiens
gaatgaggtgaccagatggtcc

SEQ ID NO: 554593 - DNA, 22 bp, Homo sapiens
tgatctggcctttaagaggatc

SEQ ID NO: 554594 - DNA, 22 bp, Homo sapiens
ctgattttatttttttcactcc

SEQ ID NO: 554595 - DNA, 22 bp, Homo sapiens
tcaaagcaagggcaagctctgc

SEQ ID NO: 554596 - DNA, 22 bp, Homo sapiens
ctgcccctgttcctgtgtccca

SEQ ID NO: 554597 - DNA, 22 bp, Homo sapiens
caggtatgtgctgagtgttctt

SEQ ID NO: 554598 - DNA, 22 bp, Homo sapiens
acagggtcacagcagggctggg

SEQ ID NO: 554599 - DNA, 22 bp, Homo sapiens
tgatggagccagttttgaggca

SEQ ID NO: 554600 - DNA, 22 bp, Homo sapiens
ttctctccaaactctgttgtac

SEQ ID NO: 554601 - DNA, 22 bp, Homo sapiens
tgagggtgttttattgtacaca

SEQ ID NO: 554602 - DNA, 22 bp, Homo sapiens
gcttttagcattggtagtgcca

SEQ ID NO: 554603 - DNA, 22 bp, Homo sapiens
ttactagtagagaaaggaaaat

SEQ ID NO: 554604 - DNA, 22 bp, Homo sapiens
atatacagggggagactctcat

SEQ ID NO: 554605 - DNA, 22 bp, Homo sapiens
taactcgcaactgtgctaactt

SEQ ID NO: 554606 - DNA, 22 bp, Homo sapiens
tcaaatgaggctgggagaggca

SEQ ID NO: 554607 - DNA, 22 bp, Homo sapiens
gactcttataacgactcactag

SEQ ID NO: 554608 - DNA, 22 bp, Homo sapiens
gctccttcccagttttgctctg

SEQ ID NO: 554609 - DNA, 22 bp, Homo sapiens
ctctctctctaaataaatacac

SEQ ID NO: 554610 - DNA, 22 bp, Homo sapiens
caggatctcagatacactcctg

SEQ ID NO: 554611 - DNA, 22 bp, Homo sapiens
tcaggatgggcagccaaactag

SEQ ID NO: 554612 - DNA, 22 bp, Homo sapiens
tttattgaaagcaccttgggga

SEQ ID NO: 554613 - DNA, 22 bp, Homo sapiens
cactgttcagtccttttcaagt

SEQ ID NO: 554614 - DNA, 22 bp, Homo sapiens
ggcagattgtaggctaagacat

SEQ ID NO: 554615 - DNA, 22 bp, Homo sapiens
ataagtgcaattatggatttgt

SEQ ID NO: 554616 - DNA, 22 bp, Homo sapiens
atttccagagggtccctctgct

SEQ ID NO: 554617 - DNA, 22 bp, Homo sapiens
gcatctcctgccagctgtctcc

SEQ ID NO: 554618 - DNA, 22 bp, Homo sapiens
tactaccctacctactaccaaa

SEQ ID NO: 554619 - DNA, 22 bp, Homo sapiens
aagtgctgtcatagctgaggtc

SEQ ID NO: 554620 - DNA, 22 bp, Homo sapiens
ggaactagtaaggaaaagcagg

SEQ ID NO: 554621 - DNA, 22 bp, Homo sapiens
agacagagaattggggaagcag

SEQ ID NO: 554622 - DNA, 22 bp, Homo sapiens
gtctgagatggaagactgtgca

SEQ ID NO: 554623 - DNA, 22 bp, Homo sapiens
tcttacattctgcagactactc

SEQ ID NO: 554624 - DNA, 22 bp, Homo sapiens
cagccagccaggtcctgcagga

SEQ ID NO: 554625 - DNA, 22 bp, Homo sapiens
atgaatatttcctgcctttggg

SEQ ID NO: 554626 - DNA, 22 bp, Homo sapiens
accggtccccgagccaagtaat

SEQ ID NO: 554627 - DNA, 22 bp, Homo sapiens
ttgatacttctttcatcctatc

SEQ ID NO: 554628 - DNA, 22 bp, Homo sapiens
ggggtagaaatgaaagagctat

SEQ ID NO: 554629 - DNA, 22 bp, Homo sapiens
tgaatttgaacagagttgaata

SEQ ID NO: 554630 - DNA, 22 bp, Homo sapiens
aagccagggtggaatgcgtggt

SEQ ID NO: 554631 - DNA, 22 bp, Homo sapiens
tatgaatggagtgacctggtgc

SEQ ID NO: 554632 - DNA, 22 bp, Homo sapiens
tggtgcacagtagacgtgtgaa

SEQ ID NO: 554633 - DNA, 22 bp, Homo sapiens
cggcggcctgtccccagtgctt

SEQ ID NO: 554634 - DNA, 22 bp, Homo sapiens
cagtggcaccttggccctcagc

SEQ ID NO: 554635 - DNA, 22 bp, Homo sapiens
gtgcctcctgcaggcggggcgg

SEQ ID NO: 554636 - DNA, 22 bp, Homo sapiens
tagatccccaggacacagggca

SEQ ID NO: 554637 - DNA, 22 bp, Homo sapiens
aagggcattcctataggacttt

SEQ ID NO: 554638 - DNA, 22 bp, Homo sapiens
agtgcgggtcggttctgcgtgc

SEQ ID NO: 554639 - DNA, 22 bp, Homo sapiens
tttccttcacacttccagtctt

SEQ ID NO: 554640 - DNA, 22 bp, Homo sapiens
tcagtaacaaagattcatcctt

SEQ ID NO: 554641 - DNA, 22 bp, Homo sapiens
cacgctttgtccttcctggggt

SEQ ID NO: 554642 - DNA, 22 bp, Homo sapiens
ttttgcgatgtgttcctaatat

SEQ ID NO: 554643 - DNA, 22 bp, Homo sapiens
tcctcacagtgacacgagcccc

SEQ ID NO: 554644 - DNA, 22 bp, Homo sapiens
ccctgaactcatggggtggggg

SEQ ID NO: 554645 - DNA, 22 bp, Homo sapiens
ggcaagcatttacattgagaga

SEQ ID NO: 554646 - DNA, 22 bp, Homo sapiens
gaccttccatggcgtcttttgt

SEQ ID NO: 554647 - DNA, 22 bp, Homo sapiens
aggttgccatagttaccaatca

SEQ ID NO: 554648 - DNA, 22 bp, Homo sapiens
tttcttatctgcaggaggcatc

SEQ ID NO: 554649 - DNA, 22 bp, Homo sapiens
tgtctagcatttataatcaact

SEQ ID NO: 554650 - DNA, 22 bp, Homo sapiens
tacacattttaataggatacag

SEQ ID NO: 554651 - DNA, 22 bp, Homo sapiens
agaatttggtcctgtgtttaga

SEQ ID NO: 554652 - DNA, 22 bp, Homo sapiens
accccggcctccctgaactttg

SEQ ID NO: 554653 - DNA, 22 bp, Homo sapiens
tactcctgcatttggtaatgat

SEQ ID NO: 554654 - DNA, 22 bp, Homo sapiens
tcatggccaggatctagggttt

SEQ ID NO: 554655 - DNA, 22 bp, Homo sapiens
ttgctgcctcccaccttcctct

SEQ ID NO: 554656 - DNA, 22 bp, Homo sapiens
tcttgaaggttctaccatacat

SEQ ID NO: 554657 - DNA, 22 bp, Homo sapiens
aggagctgggcagcctgagggt

SEQ ID NO: 554658 - DNA, 22 bp, Homo sapiens
taagtagtgtttcctactaatt

SEQ ID NO: 554659 - DNA, 22 bp, Homo sapiens
tccaactgactgtcctaatcag

SEQ ID NO: 554660 - DNA, 22 bp, Homo sapiens
tcaggctgctaaggtgtaagag

SEQ ID NO: 554661 - DNA, 22 bp, Homo sapiens
gggaagtagtccttgaccaggc

SEQ ID NO: 554662 - DNA, 22 bp, Homo sapiens
gaaagatggctgcaccgttttc

SEQ ID NO: 554663 - DNA, 22 bp, Homo sapiens
actgaggtgaagtcagcattgg

SEQ ID NO: 554664 - DNA, 22 bp, Homo sapiens
taaggtgaggattttgttctgc

SEQ ID NO: 554665 - DNA, 22 bp, Homo sapiens
gagtgattttcagggggtcgca

SEQ ID NO: 554666 - DNA, 22 bp, Homo sapiens
tggtttcttagttttgctgtct

SEQ ID NO: 554667 - DNA, 22 bp, Homo sapiens
ggatttttgcacaaagagattc

SEQ ID NO: 554668 - DNA, 22 bp, Homo sapiens
tagagagcagctttgcggtttt

SEQ ID NO: 554669 - DNA, 22 bp, Homo sapiens
tgaaacatgactcttttttctg

SEQ ID NO: 554670 - DNA, 22 bp, Homo sapiens
aggatgggggaggcaaagccaa

SEQ ID NO: 554671 - DNA, 22 bp, Homo sapiens
tggtgtgggcaaggaaaagaaa

SEQ ID NO: 554672 - DNA, 22 bp, Homo sapiens
tactagcctaatactgtgcttt

SEQ ID NO: 554673 - DNA, 22 bp, Homo sapiens
ggggtatgtgaagatcagagaa

SEQ ID NO: 554674 - DNA, 22 bp, Homo sapiens
tgctgtcctctttgcttggtct

SEQ ID NO: 554675 - DNA, 22 bp, Homo sapiens
ttattctatgggagctgacttt

SEQ ID NO: 554676 - DNA, 22 bp, Homo sapiens
tttagcagccaagtctatttta

SEQ ID NO: 554677 - DNA, 22 bp, Homo sapiens
agttcttctccttaggtccctt

SEQ ID NO: 554678 - DNA, 22 bp, Homo sapiens
ggtgggtgtgcagccagaggca

SEQ ID NO: 554679 - DNA, 22 bp, Homo sapiens
ggaatggtctaggggatcttgc

SEQ ID NO: 554680 - DNA, 22 bp, Homo sapiens
aaatgcggcctatgaatagagc

SEQ ID NO: 554681 - DNA, 22 bp, Homo sapiens
ctcattcttggtgtctgcagtt

SEQ ID NO: 554682 - DNA, 22 bp, Homo sapiens
tcagggataaaaatacccaggt

SEQ ID NO: 554683 - DNA, 22 bp, Homo sapiens
aacctgttcagggataattatg

SEQ ID NO: 554684 - DNA, 22 bp, Homo sapiens
cagggtgtatgctcagcaggca

SEQ ID NO: 554685 - DNA, 22 bp, Homo sapiens
gaggggtaggcaggagccaggc

SEQ ID NO: 554686 - DNA, 22 bp, Homo sapiens
tctggggaccactcaggcaggc

SEQ ID NO: 554687 - DNA, 22 bp, Homo sapiens
ggtcaggaatcaccagggaggt

SEQ ID NO: 554688 - DNA, 22 bp, Homo sapiens
ttgtgaccctggggaccatatg

SEQ ID NO: 554689 - DNA, 22 bp, Homo sapiens
tcttattattgatcagtttagc

SEQ ID NO: 554690 - DNA, 22 bp, Homo sapiens
tcatctctccacccaagctggg

SEQ ID NO: 554691 - DNA, 22 bp, Homo sapiens
ggaagctgatgcaaagggttcc

SEQ ID NO: 554692 - DNA, 22 bp, Homo sapiens
ttgtctgcaggcagtgaagtga

SEQ ID NO: 554693 - DNA, 22 bp, Homo sapiens
ttggcagtgtactgaaagcaca

SEQ ID NO: 554694 - DNA, 22 bp, Homo sapiens
ggctgagacagagggcgttggc

SEQ ID NO: 554695 - DNA, 22 bp, Homo sapiens
tcttgatggttcccgcatcccc

SEQ ID NO: 554696 - DNA, 22 bp, Homo sapiens
tctgcctccttccttcctcttc

SEQ ID NO: 554697 - DNA, 22 bp, Homo sapiens
gaggccatgagagatcctgggg

SEQ ID NO: 554698 - DNA, 22 bp, Homo sapiens
ctgaagagctgttttggagcct

SEQ ID NO: 554699 - DNA, 22 bp, Homo sapiens
gcagctcagtatagtacctctg

SEQ ID NO: 554700 - DNA, 22 bp, Homo sapiens
tgatatgcggtgtgtttcttct

SEQ ID NO: 554701 - DNA, 22 bp, Homo sapiens
gatcctggaggctaggttggcc

SEQ ID NO: 554702 - DNA, 22 bp, Homo sapiens
ggaatgaagaagtgaaggggtg

SEQ ID NO: 554703 - DNA, 22 bp, Homo sapiens
tattgttatccccattttgcat

SEQ ID NO: 554704 - DNA, 22 bp, Homo sapiens
ctgcagctctgtttttctctct

SEQ ID NO: 554705 - DNA, 22 bp, Homo sapiens
tcctggagagaaggaaacaaat

SEQ ID NO: 554706 - DNA, 22 bp, Homo sapiens
aattccctttctgcctgggccc

SEQ ID NO: 554707 - DNA, 22 bp, Homo sapiens
ttagagccctaaagtattcaga

SEQ ID NO: 554708 - DNA, 22 bp, Homo sapiens
tttattggtccattaatatagg

SEQ ID NO: 554709 - DNA, 22 bp, Homo sapiens
cgagggtgcagggctggggtac

SEQ ID NO: 554710 - DNA, 22 bp, Homo sapiens
tcaaagcaacattgacaaatgg

SEQ ID NO: 554711 - DNA, 22 bp, Homo sapiens
tgagaattcccacagggaaatc

SEQ ID NO: 554712 - DNA, 22 bp, Homo sapiens
ccctttgctacccaggtaaact

SEQ ID NO: 554713 - DNA, 22 bp, Homo sapiens
ccctacccactcccacccttgc

SEQ ID NO: 554714 - DNA, 22 bp, Homo sapiens
tacatggtacaatcactttgtt

SEQ ID NO: 554715 - DNA, 22 bp, Homo sapiens
gtatggagcctgggggcaggga

SEQ ID NO: 554716 - DNA, 22 bp, Homo sapiens
tagtagcttgtattaaagagac

SEQ ID NO: 554717 - DNA, 22 bp, Homo sapiens
actgcttgccttccttcatgat

SEQ ID NO: 554718 - DNA, 22 bp, Homo sapiens
gcacctgcctctgctctcccct

SEQ ID NO: 554719 - DNA, 22 bp, Homo sapiens
tctagctctgattttaagggat

SEQ ID NO: 554720 - DNA, 22 bp, Homo sapiens
tctttttctgttagtttgagtt

SEQ ID NO: 554721 - DNA, 22 bp, Homo sapiens
ccagggagtcatgagttggcaa

SEQ ID NO: 554722 - DNA, 22 bp, Homo sapiens
gcttgaggcagtactggcattc

SEQ ID NO: 554723 - DNA, 22 bp, Homo sapiens
gcagccttgactagtgacttag

SEQ ID NO: 554724 - DNA, 22 bp, Homo sapiens
gcacgcgcagtgctgccggcca

SEQ ID NO: 554725 - DNA, 22 bp, Homo sapiens
ttctagatccattccaaagtaa

SEQ ID NO: 554726 - DNA, 22 bp, Homo sapiens
tgtgacctgcagaaaagcttca

SEQ ID NO: 554727 - DNA, 22 bp, Homo sapiens
actctcattttaggtgtaaggt

SEQ ID NO: 554728 - DNA, 22 bp, Homo sapiens
gaaaggaaatgaggtttgtctg

SEQ ID NO: 554729 - DNA, 22 bp, Homo sapiens
gagtaacagctttcaagatatt

SEQ ID NO: 554730 - DNA, 22 bp, Homo sapiens
ttctgcctctgacctggagggg

SEQ ID NO: 554731 - DNA, 22 bp, Homo sapiens
aaatctcttctcacaagtgaag

SEQ ID NO: 554732 - DNA, 22 bp, Homo sapiens
aggaggtagggaggggtctgtc

SEQ ID NO: 554733 - DNA, 22 bp, Homo sapiens
aaaggataatctctggtcacat

SEQ ID NO: 554734 - DNA, 22 bp, Homo sapiens
tccctgacactctccccatggg

SEQ ID NO: 554735 - DNA, 22 bp, Homo sapiens
tgagttgactgttttgacatct

SEQ ID NO: 554736 - DNA, 22 bp, Homo sapiens
tatccatgtatgatacaactca

SEQ ID NO: 554737 - DNA, 22 bp, Homo sapiens
tcagtgttttttattcttatgt

SEQ ID NO: 554738 - DNA, 22 bp, Homo sapiens
cggtcccatcttaatccaagca

SEQ ID NO: 554739 - DNA, 22 bp, Homo sapiens
gctacgttttctagggctcaac

SEQ ID NO: 554740 - DNA, 22 bp, Homo sapiens
aggggataataatgcatcagat

SEQ ID NO: 554741 - DNA, 22 bp, Homo sapiens
taatacctgtaggtgaaagatg

SEQ ID NO: 554742 - DNA, 22 bp, Homo sapiens
ccccgccgcacttacttcccag

SEQ ID NO: 554743 - DNA, 22 bp, Homo sapiens
tgccttcctggctactgggact

SEQ ID NO: 554744 - DNA, 22 bp, Homo sapiens
tgggagcctggcaggccagagg

SEQ ID NO: 554745 - DNA, 22 bp, Homo sapiens
aaacaaggcaatcatgggcaga

SEQ ID NO: 554746 - DNA, 22 bp, Homo sapiens
tgaagcccttccaagatgactt

SEQ ID NO: 554747 - DNA, 22 bp, Homo sapiens
ctcgggggcggcacggggcggg

SEQ ID NO: 554748 - DNA, 22 bp, Homo sapiens
gggtttgtgttttatttgtaga

SEQ ID NO: 554749 - DNA, 22 bp, Homo sapiens
ttaggtctgaggggtggggaga

SEQ ID NO: 554750 - DNA, 22 bp, Homo sapiens
ctgcggggccggggcgtgccgg

SEQ ID NO: 554751 - DNA, 22 bp, Homo sapiens
tgcaggtgcccgtgagcagggc

SEQ ID NO: 554752 - DNA, 22 bp, Homo sapiens
tattcttctccaagaaggatgc

SEQ ID NO: 554753 - DNA, 22 bp, Homo sapiens
gcccagagtggagagagacttg

SEQ ID NO: 554754 - DNA, 22 bp, Homo sapiens
ggggtctgcttaggggtccact

SEQ ID NO: 554755 - DNA, 22 bp, Homo sapiens
gagtaattacatggttattcgt

SEQ ID NO: 554756 - DNA, 22 bp, Homo sapiens
gagagaggaagatgggagagct

SEQ ID NO: 554757 - DNA, 22 bp, Homo sapiens
cattctcactcaggtgcagtct

SEQ ID NO: 554758 - DNA, 22 bp, Homo sapiens
ctgatatgagtgtggagattcc

SEQ ID NO: 554759 - DNA, 22 bp, Homo sapiens
atggtgctgttcagcataacca

SEQ ID NO: 554760 - DNA, 22 bp, Homo sapiens
cgtcctactctctcactgcaag

SEQ ID NO: 554761 - DNA, 22 bp, Homo sapiens
atgcctcagtagggtggtatgc

SEQ ID NO: 554762 - DNA, 22 bp, Homo sapiens
tccctccagaggaggagggact

SEQ ID NO: 554763 - DNA, 22 bp, Homo sapiens
tcggctccctgatggggcacag

SEQ ID NO: 554764 - DNA, 22 bp, Homo sapiens
tactctgatttcggacttcagt

SEQ ID NO: 554765 - DNA, 22 bp, Homo sapiens
gggccacttactcctgctgtcc

SEQ ID NO: 554766 - DNA, 22 bp, Homo sapiens
actctttagaaagaggctgcca

SEQ ID NO: 554767 - DNA, 22 bp, Homo sapiens
tggtggtgtcttcctctggccg

SEQ ID NO: 554768 - DNA, 22 bp, Homo sapiens
tcgcagttttgttgtgccacca

SEQ ID NO: 554769 - DNA, 22 bp, Homo sapiens
tgccattagcccagtccaggcc

SEQ ID NO: 554770 - DNA, 22 bp, Homo sapiens
ggcgggagcagggagtggagac

SEQ ID NO: 554771 - DNA, 22 bp, Homo sapiens
caggaggagggacccagggcct

SEQ ID NO: 554772 - DNA, 22 bp, Homo sapiens
ttattctcgattatctgataaa

SEQ ID NO: 554773 - DNA, 22 bp, Homo sapiens
taactaaaggccaaagttttca

SEQ ID NO: 554774 - DNA, 22 bp, Homo sapiens
cgcttccccagccaggccccgc

SEQ ID NO: 554775 - DNA, 22 bp, Homo sapiens
agaaggttaaacctgtgtcagg

SEQ ID NO: 554776 - DNA, 22 bp, Homo sapiens
agtaccctgaaggaggggcagg

SEQ ID NO: 554777 - DNA, 22 bp, Homo sapiens
tccagttactctgggactcgtt

SEQ ID NO: 554778 - DNA, 22 bp, Homo sapiens
gatcaagaacttcagggaccct

SEQ ID NO: 554779 - DNA, 22 bp, Homo sapiens
tgagtcatctgtggacacaggt

SEQ ID NO: 554780 - DNA, 22 bp, Homo sapiens
ttgatagtcatggaacattatg

SEQ ID NO: 554781 - DNA, 22 bp, Homo sapiens
tcattttacaggcagacctgtc

SEQ ID NO: 554782 - DNA, 22 bp, Homo sapiens
atagggttttcaaatcagaatt

SEQ ID NO: 554783 - DNA, 22 bp, Homo sapiens
tttgccatccttacctacagcc

SEQ ID NO: 554784 - DNA, 22 bp, Homo sapiens
cagtcgcatggcagccagctgg

SEQ ID NO: 554785 - DNA, 22 bp, Homo sapiens
gaaatgaagtgcttagagaagg

SEQ ID NO: 554786 - DNA, 22 bp, Homo sapiens
tggtctggacagacctggaacc

SEQ ID NO: 554787 - DNA, 22 bp, Homo sapiens
ggttttacactatatacctaga

SEQ ID NO: 554788 - DNA, 22 bp, Homo sapiens
gcccaaatggataaatttatct

SEQ ID NO: 554789 - DNA, 22 bp, Homo sapiens
tgtctgagctggatgtgcaaac

SEQ ID NO: 554790 - DNA, 22 bp, Homo sapiens
agtgtttttaacagggtttcca

SEQ ID NO: 554791 - DNA, 22 bp, Homo sapiens
ttgatccagtctttcttgagcc

SEQ ID NO: 554792 - DNA, 22 bp, Homo sapiens
ttcaaaagaaactgaaagcacc

SEQ ID NO: 554793 - DNA, 22 bp, Homo sapiens
tgactcagggagcagctctgtg

SEQ ID NO: 554794 - DNA, 22 bp, Homo sapiens
tatggtttctacttttctcttt

SEQ ID NO: 554795 - DNA, 22 bp, Homo sapiens
ttagatcagtagttggtaaggg

SEQ ID NO: 554796 - DNA, 22 bp, Homo sapiens
aatgctgggagccatcttgaat

SEQ ID NO: 554797 - DNA, 22 bp, Homo sapiens
acctgagagaagagggtagaag

SEQ ID NO: 554798 - DNA, 22 bp, Homo sapiens
ggcagggatacaggtgtgtgaa

SEQ ID NO: 554799 - DNA, 22 bp, Homo sapiens
tgacttctactattttcctggg

SEQ ID NO: 554800 - DNA, 22 bp, Homo sapiens
gctttccagcttcctcaatagg

SEQ ID NO: 554801 - DNA, 22 bp, Homo sapiens
tgggccttgagaatcatgtttc

SEQ ID NO: 554802 - DNA, 22 bp, Homo sapiens
agaacctttgccctcctttcct

SEQ ID NO: 554803 - DNA, 22 bp, Homo sapiens
tggattggtcctgcctgagcat

SEQ ID NO: 554804 - DNA, 22 bp, Homo sapiens
tttagtgggggcagaatcaggt

SEQ ID NO: 554805 - DNA, 22 bp, Homo sapiens
gggaccctcattcatttgcagc

SEQ ID NO: 554806 - DNA, 22 bp, Homo sapiens
tgcaggctctttattactggtg

SEQ ID NO: 554807 - DNA, 22 bp, Homo sapiens
aaatgcgacaagctgtggatgt

SEQ ID NO: 554808 - DNA, 22 bp, Homo sapiens
ggtggtaaccttgtgatcccca

SEQ ID NO: 554809 - DNA, 22 bp, Homo sapiens
catatgcaaaggggaaggcttt

SEQ ID NO: 554810 - DNA, 22 bp, Homo sapiens
tctgcaagtgttcatcatgacg

SEQ ID NO: 554811 - DNA, 22 bp, Homo sapiens
gaaaagggcaagagagagggca

SEQ ID NO: 554812 - DNA, 22 bp, Homo sapiens
tgttgatctcaagatttactcc

SEQ ID NO: 554813 - DNA, 22 bp, Homo sapiens
tgtgcattttccatttgagtcc

SEQ ID NO: 554814 - DNA, 22 bp, Homo sapiens
gttggggccagtgggaggctga

SEQ ID NO: 554815 - DNA, 22 bp, Homo sapiens
acaggccccctgggagcttggt

SEQ ID NO: 554816 - DNA, 22 bp, Homo sapiens
tcctgatctgggctgcccgggg

SEQ ID NO: 554817 - DNA, 22 bp, Homo sapiens
acttctgttaactaaaagacag

SEQ ID NO: 554818 - DNA, 22 bp, Homo sapiens
tgttgcggtcatgggccataaa

SEQ ID NO: 554819 - DNA, 22 bp, Homo sapiens
ccccagcagcgggccactctcc

SEQ ID NO: 554820 - DNA, 22 bp, Homo sapiens
cctgcagggtttgcatcaatta

SEQ ID NO: 554821 - DNA, 22 bp, Homo sapiens
gggaccttatgaaagtggaacg

SEQ ID NO: 554822 - DNA, 22 bp, Homo sapiens
ctgctttggttttggaggcagg

SEQ ID NO: 554823 - DNA, 22 bp, Homo sapiens
agtttcctcatctttggactgc

SEQ ID NO: 554824 - DNA, 22 bp, Homo sapiens
cctgtttgctcctctgggcccc

SEQ ID NO: 554825 - DNA, 22 bp, Homo sapiens
ttgacctcctgaatgttttcat

SEQ ID NO: 554826 - DNA, 22 bp, Homo sapiens
tcagaatttcctcttgcatatc

SEQ ID NO: 554827 - DNA, 22 bp, Homo sapiens
ctcgtctcctgctctcactcca

SEQ ID NO: 554828 - DNA, 22 bp, Homo sapiens
ccagtgaatatttattgagttc

SEQ ID NO: 554829 - DNA, 22 bp, Homo sapiens
taaaacactgacaaatctgtta

SEQ ID NO: 554830 - DNA, 22 bp, Homo sapiens
taatcacaggctcatgataagc

SEQ ID NO: 554831 - DNA, 22 bp, Homo sapiens
acaaatacttattgaggacctg

SEQ ID NO: 554832 - DNA, 22 bp, Homo sapiens
tagtgtccataatctctagaga

SEQ ID NO: 554833 - DNA, 22 bp, Homo sapiens
gagcactggccttggtcctggg

SEQ ID NO: 554834 - DNA, 22 bp, Homo sapiens
aaagacaggggtggagacaggg

SEQ ID NO: 554835 - DNA, 22 bp, Homo sapiens
gttcctctgccgactatttcag

SEQ ID NO: 554836 - DNA, 22 bp, Homo sapiens
ctggggtagggactgggtgggg

SEQ ID NO: 554837 - DNA, 22 bp, Homo sapiens
atgaaagattcatacacatctg

SEQ ID NO: 554838 - DNA, 22 bp, Homo sapiens
tgtcctctgcagtgggacgggg

SEQ ID NO: 554839 - DNA, 22 bp, Homo sapiens
cacgttcgtctgtcccatgtta

SEQ ID NO: 554840 - DNA, 22 bp, Homo sapiens
tggggccgcagaccctgggcgc

SEQ ID NO: 554841 - DNA, 22 bp, Homo sapiens
agctcatcttggctcttggtta

SEQ ID NO: 554842 - DNA, 22 bp, Homo sapiens
cttataatatgtataatctact

SEQ ID NO: 554843 - DNA, 22 bp, Homo sapiens
atctgcattagtattttcctcc

SEQ ID NO: 554844 - DNA, 22 bp, Homo sapiens
ttttcctttggcttccttcctg

SEQ ID NO: 554845 - DNA, 22 bp, Homo sapiens
cagtgaggtgcccagcctgctc

SEQ ID NO: 554846 - DNA, 22 bp, Homo sapiens
tcaggggacaggagtgcttcct

SEQ ID NO: 554847 - DNA, 22 bp, Homo sapiens
tccttctcatattcttggaaaa

SEQ ID NO: 554848 - DNA, 22 bp, Homo sapiens
tggaggaggcggtgcaggggtc

SEQ ID NO: 554849 - DNA, 22 bp, Homo sapiens
tcgggggacactggggcaagag

SEQ ID NO: 554850 - DNA, 22 bp, Homo sapiens
attaagtgtcagttaatccctg

SEQ ID NO: 554851 - DNA, 22 bp, Homo sapiens
tgagagttcctgtgtcagtagg

SEQ ID NO: 554852 - DNA, 22 bp, Homo sapiens
atgggtccccagggcctggaat

SEQ ID NO: 554853 - DNA, 22 bp, Homo sapiens
tatgtgagaccttgagcaagtc

SEQ ID NO: 554854 - DNA, 22 bp, Homo sapiens
tgagttgagttctgaactttcc

SEQ ID NO: 554855 - DNA, 22 bp, Homo sapiens
cagtagttatcacagtgtctgt

SEQ ID NO: 554856 - DNA, 22 bp, Homo sapiens
tccctccgtttcccattgccag

SEQ ID NO: 554857 - DNA, 22 bp, Homo sapiens
taggcctaggcccggtgagaga

SEQ ID NO: 554858 - DNA, 22 bp, Homo sapiens
aacttgtctgatcgtagaactc

SEQ ID NO: 554859 - DNA, 22 bp, Homo sapiens
atgtttcccgggcaacctcttt

SEQ ID NO: 554860 - DNA, 22 bp, Homo sapiens
acagggaatggctttgctttat

SEQ ID NO: 554861 - DNA, 22 bp, Homo sapiens
tcgggaggaaaagaaagaagac

SEQ ID NO: 554862 - DNA, 22 bp, Homo sapiens
tgcagagtttgttcgggagaat

SEQ ID NO: 554863 - DNA, 22 bp, Homo sapiens
aaacgaggctagaagaggcagt

SEQ ID NO: 554864 - DNA, 22 bp, Homo sapiens
ctggtgagagaggtgcccagga

SEQ ID NO: 554865 - DNA, 22 bp, Homo sapiens
aactggggcgggaagggggaag

SEQ ID NO: 554866 - DNA, 22 bp, Homo sapiens
tgtttttatctgagcttccatt

SEQ ID NO: 554867 - DNA, 22 bp, Homo sapiens
tcagggatgcagggtgttggtt

SEQ ID NO: 554868 - DNA, 22 bp, Homo sapiens
tcccatatctcgtttccaccaa

SEQ ID NO: 554869 - DNA, 22 bp, Homo sapiens
aggcacagcattaggctagtaa

SEQ ID NO: 554870 - DNA, 22 bp, Homo sapiens
acttttcaagctggtttttgga

SEQ ID NO: 554871 - DNA, 22 bp, Homo sapiens
ccaattctgttttcaatggctt

SEQ ID NO: 554872 - DNA, 22 bp, Homo sapiens
tgattatgatgtacattcagag

SEQ ID NO: 554873 - DNA, 22 bp, Homo sapiens
tggtggggaagaagtgggggca

SEQ ID NO: 554874 - DNA, 22 bp, Homo sapiens
ctgggcagggctccaggacatg

SEQ ID NO: 554875 - DNA, 22 bp, Homo sapiens
ttcttttctctggatggatgta

SEQ ID NO: 554876 - DNA, 22 bp, Homo sapiens
acaggcgtgggaaaggcccccg

SEQ ID NO: 554877 - DNA, 22 bp, Homo sapiens
cctgcacagggggctgcaggcc

SEQ ID NO: 554878 - DNA, 22 bp, Homo sapiens
tgagagagcttgatgcctcctt

SEQ ID NO: 554879 - DNA, 22 bp, Homo sapiens
ccgcctgggatgtccgggtggg

SEQ ID NO: 554880 - DNA, 22 bp, Homo sapiens
ggtcaagagcagcatgagctat

SEQ ID NO: 554881 - DNA, 22 bp, Homo sapiens
tttttacaggagtttattatgt

SEQ ID NO: 554882 - DNA, 22 bp, Homo sapiens
tgagacaacctaattaaacacc

SEQ ID NO: 554883 - DNA, 22 bp, Homo sapiens
tacagcatttgcaggaattgta

SEQ ID NO: 554884 - DNA, 22 bp, Homo sapiens
ggcacagctgccatcccctgcc

SEQ ID NO: 554885 - DNA, 22 bp, Homo sapiens
tcactggagtaccatttagcaa

SEQ ID NO: 554886 - DNA, 22 bp, Homo sapiens
tattaggttggtgcaaaagtca

SEQ ID NO: 554887 - DNA, 22 bp, Homo sapiens
tcctgttgccatctgcatctct

SEQ ID NO: 554888 - DNA, 22 bp, Homo sapiens
tgatgcaaactttgtttaccag

SEQ ID NO: 554889 - DNA, 22 bp, Homo sapiens
ctgtggtttattcaagggttat

SEQ ID NO: 554890 - DNA, 22 bp, Homo sapiens
tgcagcccagtggtgaggtggg

SEQ ID NO: 554891 - DNA, 22 bp, Homo sapiens
gccttgccctgaggttgagaga

SEQ ID NO: 554892 - DNA, 22 bp, Homo sapiens
tcctcagagagcaccaccctgt

SEQ ID NO: 554893 - DNA, 22 bp, Homo sapiens
cctgtgttgagtgcctctgtgt

SEQ ID NO: 554894 - DNA, 22 bp, Homo sapiens
tggttattatgtggctcaatga

SEQ ID NO: 554895 - DNA, 22 bp, Homo sapiens
tgccctgggccctgggtcgtcc

SEQ ID NO: 554896 - DNA, 22 bp, Homo sapiens
tgccttccccaccagctgcctt

SEQ ID NO: 554897 - DNA, 22 bp, Homo sapiens
agtagggtgcacccggaattga

SEQ ID NO: 554898 - DNA, 22 bp, Homo sapiens
agagtaaacagatagaatgcag

SEQ ID NO: 554899 - DNA, 22 bp, Homo sapiens
tgtctgtgcggaagacaatgtg

SEQ ID NO: 554900 - DNA, 22 bp, Homo sapiens
ctgctaagcctctaaggtgaga

SEQ ID NO: 554901 - DNA, 22 bp, Homo sapiens
ccttgagtgcatcgtgggtgtc

SEQ ID NO: 554902 - DNA, 22 bp, Homo sapiens
acagtacaagtcagtgaggcaa

SEQ ID NO: 554903 - DNA, 22 bp, Homo sapiens
ttactcatgggatcaacattct

SEQ ID NO: 554904 - DNA, 22 bp, Homo sapiens
ttatactattccacccacctta

SEQ ID NO: 554905 - DNA, 22 bp, Homo sapiens
tgggagaataaggtagtgtggt

SEQ ID NO: 554906 - DNA, 22 bp, Homo sapiens
tggctgcctggggagctgtctg

SEQ ID NO: 554907 - DNA, 22 bp, Homo sapiens
agagcatacttttgcactttca

SEQ ID NO: 554908 - DNA, 22 bp, Homo sapiens
tcgtgtacttttatatcctggc

SEQ ID NO: 554909 - DNA, 22 bp, Homo sapiens
ccgcctgcgccgggctcagtct

SEQ ID NO: 554910 - DNA, 22 bp, Homo sapiens
ttggtgatggtgttgtataggg

SEQ ID NO: 554911 - DNA, 22 bp, Homo sapiens
cagggaaggcctgagggctggt

SEQ ID NO: 554912 - DNA, 22 bp, Homo sapiens
tgtatgtgtgtgggtggtagtg

SEQ ID NO: 554913 - DNA, 22 bp, Homo sapiens
ctcaggcgggaagtaggctggg

SEQ ID NO: 554914 - DNA, 22 bp, Homo sapiens
agggttttgtctgtattgtttg

SEQ ID NO: 554915 - DNA, 22 bp, Homo sapiens
tgtctcccacatgggaggagtg

SEQ ID NO: 554916 - DNA, 22 bp, Homo sapiens
ttcctagaggtctccacctctc

SEQ ID NO: 554917 - DNA, 22 bp, Homo sapiens
cttcatttccctcttggcttct

SEQ ID NO: 554918 - DNA, 22 bp, Homo sapiens
tggaggcagaaataggacttgt

SEQ ID NO: 554919 - DNA, 22 bp, Homo sapiens
ttctgaagtgggaaaacctcaa

SEQ ID NO: 554920 - DNA, 22 bp, Homo sapiens
ggctgggcggaggtggggtcag

SEQ ID NO: 554921 - DNA, 22 bp, Homo sapiens
gtagaaagaggcctgataatct

SEQ ID NO: 554922 - DNA, 22 bp, Homo sapiens
gctggtttggggtagaggacag

SEQ ID NO: 554923 - DNA, 22 bp, Homo sapiens
cctgctcttccttccctatatt

SEQ ID NO: 554924 - DNA, 22 bp, Homo sapiens
tgatttttggatctgagctgca

SEQ ID NO: 554925 - DNA, 22 bp, Homo sapiens
tcaggttttgctataatggata

SEQ ID NO: 554926 - DNA, 22 bp, Homo sapiens
tttcttccactatatggtgata

SEQ ID NO: 554927 - DNA, 22 bp, Homo sapiens
tccacctcaatttattcctaat

SEQ ID NO: 554928 - DNA, 22 bp, Homo sapiens
agctcgcgggtgacgggtgtgg

SEQ ID NO: 554929 - DNA, 22 bp, Homo sapiens
attacttctaaatggaggggta

SEQ ID NO: 554930 - DNA, 22 bp, Homo sapiens
tcccccatcctcgaccatcttt

SEQ ID NO: 554931 - DNA, 22 bp, Homo sapiens
ttgtacaaagtcacatgagtca

SEQ ID NO: 554932 - DNA, 22 bp, Homo sapiens
ttaaaattccatctgatttctg

SEQ ID NO: 554933 - DNA, 22 bp, Homo sapiens
accttcaaattgccagtgtttt

SEQ ID NO: 554934 - DNA, 22 bp, Homo sapiens
tcttctgtgaccttgggccagt

SEQ ID NO: 554935 - DNA, 22 bp, Homo sapiens
tggaaatggtaaacattttaat

SEQ ID NO: 554936 - DNA, 22 bp, Homo sapiens
tactggcatttttccattaaat

SEQ ID NO: 554937 - DNA, 22 bp, Homo sapiens
tgatcagattttaaaatcagtt

SEQ ID NO: 554938 - DNA, 22 bp, Homo sapiens
tcaggtctgcattttagaaaga

SEQ ID NO: 554939 - DNA, 22 bp, Homo sapiens
aggggtgggggaccccaggaga

SEQ ID NO: 554940 - DNA, 22 bp, Homo sapiens
acaccagagcaactcccttcat

SEQ ID NO: 554941 - DNA, 22 bp, Homo sapiens
gagggctgccttgtcagtaaat

SEQ ID NO: 554942 - DNA, 22 bp, Homo sapiens
cagactgggtgagaaccgccag

SEQ ID NO: 554943 - DNA, 22 bp, Homo sapiens
cctcagaggatgccccaagacc

SEQ ID NO: 554944 - DNA, 22 bp, Homo sapiens
agcattatgtttgaacagatgg

SEQ ID NO: 554945 - DNA, 22 bp, Homo sapiens
cacatgagaggctgtacctgtt

SEQ ID NO: 554946 - DNA, 22 bp, Homo sapiens
tacaagtcccagtatgcattgc

SEQ ID NO: 554947 - DNA, 22 bp, Homo sapiens
tctttgtggccagggtgggaga

SEQ ID NO: 554948 - DNA, 22 bp, Homo sapiens
ggggttcagatctcctacttga

SEQ ID NO: 554949 - DNA, 22 bp, Homo sapiens
tttatttttctaaggagaccag

SEQ ID NO: 554950 - DNA, 22 bp, Homo sapiens
aggagcaggctgtgtgggcctc

SEQ ID NO: 554951 - DNA, 22 bp, Homo sapiens
tggggaagagcagattaagcag

SEQ ID NO: 554952 - DNA, 22 bp, Homo sapiens
gggttggaggcctgcgtgtccc

SEQ ID NO: 554953 - DNA, 22 bp, Homo sapiens
ccacttactatatatcgatgta

SEQ ID NO: 554954 - DNA, 22 bp, Homo sapiens
tagcgaaagggattctggccaa

SEQ ID NO: 554955 - DNA, 22 bp, Homo sapiens
ccctttctctggagtcactcag

SEQ ID NO: 554956 - DNA, 22 bp, Homo sapiens
cagatgagacagctggggaatt

SEQ ID NO: 554957 - DNA, 22 bp, Homo sapiens
actatatgtgggtgttataagg

SEQ ID NO: 554958 - DNA, 22 bp, Homo sapiens
cccacacgcatttatatacagt

SEQ ID NO: 554959 - DNA, 22 bp, Homo sapiens
tgaagcaggtatgttcaatttt

SEQ ID NO: 554960 - DNA, 22 bp, Homo sapiens
cctgcatggtggtggggcggga

SEQ ID NO: 554961 - DNA, 22 bp, Homo sapiens
tgggaagggagagcccttggct

SEQ ID NO: 554962 - DNA, 22 bp, Homo sapiens
ggaggagggaggagatgggcca

SEQ ID NO: 554963 - DNA, 22 bp, Homo sapiens
ccgggaccgcagcgctcacggc

SEQ ID NO: 554964 - DNA, 22 bp, Homo sapiens
ggaggagggcgcaaagtccttt

SEQ ID NO: 554965 - DNA, 22 bp, Homo sapiens
aaaggatagggaggcctctcag

SEQ ID NO: 554966 - DNA, 22 bp, Homo sapiens
ctgaggtttgactgccccccac

SEQ ID NO: 554967 - DNA, 22 bp, Homo sapiens
tcatcaagcaaaggttaagggc

SEQ ID NO: 554968 - DNA, 22 bp, Homo sapiens
tctttatgtctgagtttcttgg

SEQ ID NO: 554969 - DNA, 22 bp, Homo sapiens
tcaatatttacctctcaggtca

SEQ ID NO: 554970 - DNA, 22 bp, Homo sapiens
tggcatcttggcatcttgctgc

SEQ ID NO: 554971 - DNA, 22 bp, Homo sapiens
agatttctacttaaatattgtt

SEQ ID NO: 554972 - DNA, 22 bp, Homo sapiens
ctcggatctaggactatacatc

SEQ ID NO: 554973 - DNA, 22 bp, Homo sapiens
ctgcaggcatcctgagcaggag

SEQ ID NO: 554974 - DNA, 22 bp, Homo sapiens
aaacagaattggtctctttaat

SEQ ID NO: 554975 - DNA, 22 bp, Homo sapiens
tgttgctttcttttctatacag

SEQ ID NO: 554976 - DNA, 22 bp, Homo sapiens
ttcaaccccatcctccacccct

SEQ ID NO: 554977 - DNA, 22 bp, Homo sapiens
agactatgggcacaggttagct

SEQ ID NO: 554978 - DNA, 22 bp, Homo sapiens
tatttgtctgtttttctcatac

SEQ ID NO: 554979 - DNA, 22 bp, Homo sapiens
tgctgcttctgaactggggtcc

SEQ ID NO: 554980 - DNA, 22 bp, Homo sapiens
ccatcctgccagccctgggcca

SEQ ID NO: 554981 - DNA, 22 bp, Homo sapiens
agtagagtcagcagtcaaactg

SEQ ID NO: 554982 - DNA, 22 bp, Homo sapiens
tcagacagtttgcaagcgtcaa

SEQ ID NO: 554983 - DNA, 22 bp, Homo sapiens
tggatgtgtaatgattatgttg

SEQ ID NO: 554984 - DNA, 22 bp, Homo sapiens
gcacgttgtccagctgggcatc

SEQ ID NO: 554985 - DNA, 22 bp, Homo sapiens
cagagaccagtctccagtggtt

SEQ ID NO: 554986 - DNA, 22 bp, Homo sapiens
ttttactgcctttgttttacca

SEQ ID NO: 554987 - DNA, 22 bp, Homo sapiens
aggaagtggctgggctgggttg

SEQ ID NO: 554988 - DNA, 22 bp, Homo sapiens
cagtatatggtggtagaggcac

SEQ ID NO: 554989 - DNA, 22 bp, Homo sapiens
ccagagggtgcaggggaggcaa

SEQ ID NO: 554990 - DNA, 22 bp, Homo sapiens
ttgtggggtcggggtccttcgg

SEQ ID NO: 554991 - DNA, 22 bp, Homo sapiens
gtttccatatgcatacatagtg

SEQ ID NO: 554992 - DNA, 22 bp, Homo sapiens
cttggcaggtgttgggaggcct

SEQ ID NO: 554993 - DNA, 22 bp, Homo sapiens
tattgtaatgcgattgatacaa

SEQ ID NO: 554994 - DNA, 22 bp, Homo sapiens
tttagggtgtggcatctgccat

SEQ ID NO: 554995 - DNA, 22 bp, Homo sapiens
agagaatgagttggtacataag

SEQ ID NO: 554996 - DNA, 22 bp, Homo sapiens
tttattattccatttactctga

SEQ ID NO: 554997 - DNA, 22 bp, Homo sapiens
cagatctggaagctgggaggtt

SEQ ID NO: 554998 - DNA, 22 bp, Homo sapiens
taagccaggtcacctctgaact

SEQ ID NO: 554999 - DNA, 22 bp, Homo sapiens
tctctcacctggcataagcaat

SEQ ID NO: 555000 - DNA, 22 bp, Homo sapiens
ttatgcacacttgaataatgta

SEQ ID NO: 555001 - DNA, 22 bp, Homo sapiens
tttcctcatagaaggatatgac

SEQ ID NO: 555002 - DNA, 22 bp, Homo sapiens
tgtgctaaaattgcagacacta

SEQ ID NO: 555003 - DNA, 22 bp, Homo sapiens
gaacaggatgggtgctcactaa

SEQ ID NO: 555004 - DNA, 22 bp, Homo sapiens
cctgagactctcctgtgcagcc

SEQ ID NO: 555005 - DNA, 22 bp, Homo sapiens
ggtagaattagacctcggggcc

SEQ ID NO: 555006 - DNA, 22 bp, Homo sapiens
ttgtgtttctctggtaaccttc

SEQ ID NO: 555007 - DNA, 22 bp, Homo sapiens
tgcaatgatattgtcaaagcat

SEQ ID NO: 555008 - DNA, 22 bp, Homo sapiens
tgcagtgcctcggcagtgcagc

SEQ ID NO: 555009 - DNA, 22 bp, Homo sapiens
ctgagcgtttcttcttgatcct

SEQ ID NO: 555010 - DNA, 22 bp, Homo sapiens
atcaatatttggcatggattgg

SEQ ID NO: 555011 - DNA, 22 bp, Homo sapiens
tgcgggcttttggttcactgtc

SEQ ID NO: 555012 - DNA, 22 bp, Homo sapiens
tgaatgcacggatgtgtatgaa

SEQ ID NO: 555013 - DNA, 22 bp, Homo sapiens
agcagaggatggcagttccaca

SEQ ID NO: 555014 - DNA, 22 bp, Homo sapiens
ttgtcatttcgggcatggagtc

SEQ ID NO: 555015 - DNA, 22 bp, Homo sapiens
catgtgcagtgagatgggtgcc

SEQ ID NO: 555016 - DNA, 22 bp, Homo sapiens
cctctcctcagtcgggaaggat

SEQ ID NO: 555017 - DNA, 22 bp, Homo sapiens
tacttctggaggtaaatcttag

SEQ ID NO: 555018 - DNA, 22 bp, Homo sapiens
cggacgcagggccccgattcca

SEQ ID NO: 555019 - DNA, 22 bp, Homo sapiens
cagctggaacggcagcccagca

SEQ ID NO: 555020 - DNA, 22 bp, Homo sapiens
tgcccacccatgccacagggct

SEQ ID NO: 555021 - DNA, 22 bp, Homo sapiens
atgtcagcatgcattttggcat

SEQ ID NO: 555022 - DNA, 22 bp, Homo sapiens
gaggagaagggggaggtgatat

SEQ ID NO: 555023 - DNA, 22 bp, Homo sapiens
cagaggctgggagtcagcagca

SEQ ID NO: 555024 - DNA, 22 bp, Homo sapiens
tgggctctgggccggaggcatc

SEQ ID NO: 555025 - DNA, 22 bp, Homo sapiens
aaagacagagtgtgtgtgctga

SEQ ID NO: 555026 - DNA, 22 bp, Homo sapiens
ctggtacttttgtggtaatctc

SEQ ID NO: 555027 - DNA, 22 bp, Homo sapiens
tctcttcccttagatgtaaaat

SEQ ID NO: 555028 - DNA, 22 bp, Homo sapiens
gaaattggatcaaatgagtggg

SEQ ID NO: 555029 - DNA, 22 bp, Homo sapiens
ttatgatgtcacaaagaggtaa

SEQ ID NO: 555030 - DNA, 22 bp, Homo sapiens
agacctatctataaaagtgaat

SEQ ID NO: 555031 - DNA, 22 bp, Homo sapiens
gcaggatgcggaatggcaggtg

SEQ ID NO: 555032 - DNA, 22 bp, Homo sapiens
ggagttggggcatggggcattt

SEQ ID NO: 555033 - DNA, 22 bp, Homo sapiens
tctgttccccttttcctgccac

SEQ ID NO: 555034 - DNA, 22 bp, Homo sapiens
acaaggggtcagatctggatta

SEQ ID NO: 555035 - DNA, 22 bp, Homo sapiens
cagctctgctccatcagttgcc

SEQ ID NO: 555036 - DNA, 22 bp, Homo sapiens
tgaaatagagcccttgttcttg

SEQ ID NO: 555037 - DNA, 22 bp, Homo sapiens
cgtagatgctgaaacatggagg

SEQ ID NO: 555038 - DNA, 22 bp, Homo sapiens
aaccatacatgggttctgcagg

SEQ ID NO: 555039 - DNA, 22 bp, Homo sapiens
tgctgtttcactcacatcttta

SEQ ID NO: 555040 - DNA, 22 bp, Homo sapiens
tgtgtcccttctttaagagtgt

SEQ ID NO: 555041 - DNA, 22 bp, Homo sapiens
agaactttggctttatttactt

SEQ ID NO: 555042 - DNA, 22 bp, Homo sapiens
taagtagggtttggaactggga

SEQ ID NO: 555043 - DNA, 22 bp, Homo sapiens
gtcgggatggcacaagactact

SEQ ID NO: 555044 - DNA, 22 bp, Homo sapiens
tgaggcctaagcttggtggctg

SEQ ID NO: 555045 - DNA, 22 bp, Homo sapiens
ttacatccataggctctgcttc

SEQ ID NO: 555046 - DNA, 22 bp, Homo sapiens
aacagatagaggctcccatgta

SEQ ID NO: 555047 - DNA, 22 bp, Homo sapiens
acaggagggcctgactactccc

SEQ ID NO: 555048 - DNA, 22 bp, Homo sapiens
taatagtgaaaatgctgtcagc

SEQ ID NO: 555049 - DNA, 22 bp, Homo sapiens
ctatgaaacacaaagaccgagt

SEQ ID NO: 555050 - DNA, 22 bp, Homo sapiens
aggaggggcagccagccactgt

SEQ ID NO: 555051 - DNA, 22 bp, Homo sapiens
tcctctccactcttgtttagat

SEQ ID NO: 555052 - DNA, 22 bp, Homo sapiens
ttctaactgcccctgtgctgca

SEQ ID NO: 555053 - DNA, 22 bp, Homo sapiens
cattccctggagttgggcaatc

SEQ ID NO: 555054 - DNA, 22 bp, Homo sapiens
ttccagctgttttgttgaactg

SEQ ID NO: 555055 - DNA, 22 bp, Homo sapiens
gcatggctgagctaagcatgtc

SEQ ID NO: 555056 - DNA, 22 bp, Homo sapiens
ttacaatgaaacttttggctgg

SEQ ID NO: 555057 - DNA, 22 bp, Homo sapiens
taaatgggtgtgtttgatgaat

SEQ ID NO: 555058 - DNA, 22 bp, Homo sapiens
gaagggaagaatggggagatgg

SEQ ID NO: 555059 - DNA, 22 bp, Homo sapiens
gaatcccgaaccctgcctagga

SEQ ID NO: 555060 - DNA, 22 bp, Homo sapiens
ggaaagggaggacaggaacagg

SEQ ID NO: 555061 - DNA, 22 bp, Homo sapiens
tgctctgatggtgcttttgggg

SEQ ID NO: 555062 - DNA, 22 bp, Homo sapiens
tttttctagtggttgcatgatt

SEQ ID NO: 555063 - DNA, 22 bp, Homo sapiens
tcccaggcccgggattaggcac

SEQ ID NO: 555064 - DNA, 22 bp, Homo sapiens
gcttttcccctggaggatcctc

SEQ ID NO: 555065 - DNA, 22 bp, Homo sapiens
agttatcacagtgactgtcatt

SEQ ID NO: 555066 - DNA, 22 bp, Homo sapiens
ttgagagctcgtgtagaaagcc

SEQ ID NO: 555067 - DNA, 22 bp, Homo sapiens
tgaacatgtgtgtggccctgga

SEQ ID NO: 555068 - DNA, 22 bp, Homo sapiens
caaattacttatctctgttccg

SEQ ID NO: 555069 - DNA, 22 bp, Homo sapiens
tggtaccctggtgacttagaga

SEQ ID NO: 555070 - DNA, 22 bp, Homo sapiens
tggcccaggtgcacccagaggc

SEQ ID NO: 555071 - DNA, 22 bp, Homo sapiens
ccagagcggttagcagagctgg

SEQ ID NO: 555072 - DNA, 22 bp, Homo sapiens
taggaaggcgggtaagggctgg

SEQ ID NO: 555073 - DNA, 22 bp, Homo sapiens
ttatgtgtggcatattaggttg

SEQ ID NO: 555074 - DNA, 22 bp, Homo sapiens
tgacactcataccaggcattga

SEQ ID NO: 555075 - DNA, 22 bp, Homo sapiens
gcaagagcaggagcaggagtcc

SEQ ID NO: 555076 - DNA, 22 bp, Homo sapiens
ggggcagggacgcggtgggcgg

SEQ ID NO: 555077 - DNA, 22 bp, Homo sapiens
tgtgtccagttctgttacatga

SEQ ID NO: 555078 - DNA, 22 bp, Homo sapiens
cagacactgtaggtgagagctg

SEQ ID NO: 555079 - DNA, 22 bp, Homo sapiens
taggtggtttagagtatgtgga

SEQ ID NO: 555080 - DNA, 22 bp, Homo sapiens
tcctccccgccccctctgccgg

SEQ ID NO: 555081 - DNA, 22 bp, Homo sapiens
cttggtgaatcaaaactgagag

SEQ ID NO: 555082 - DNA, 22 bp, Homo sapiens
ttttgctgaatgatttctggtg

SEQ ID NO: 555083 - DNA, 22 bp, Homo sapiens
gggcttctggtctgcctgctgt

SEQ ID NO: 555084 - DNA, 22 bp, Homo sapiens
agacttggagttaaagttcaat

SEQ ID NO: 555085 - DNA, 22 bp, Homo sapiens
cactgtgtttgatgccaataat

SEQ ID NO: 555086 - DNA, 22 bp, Homo sapiens
tgctggacgcggacgctcgcca

SEQ ID NO: 555087 - DNA, 22 bp, Homo sapiens
cacacgtccagggctgtctgca

SEQ ID NO: 555088 - DNA, 22 bp, Homo sapiens
tgactgtgcccctggccagcga

SEQ ID NO: 555089 - DNA, 22 bp, Homo sapiens
gatggggagggtgggtgtaggg

SEQ ID NO: 555090 - DNA, 22 bp, Homo sapiens
ttttcttatttgtaaaataggg

SEQ ID NO: 555091 - DNA, 22 bp, Homo sapiens
tgtgtatctctccagagatgct

SEQ ID NO: 555092 - DNA, 22 bp, Homo sapiens
cacataactgagggtagagttt

SEQ ID NO: 555093 - DNA, 22 bp, Homo sapiens
tgtttagccagcttcattaaca

SEQ ID NO: 555094 - DNA, 22 bp, Homo sapiens
gctatggttgaccagcaggatt

SEQ ID NO: 555095 - DNA, 22 bp, Homo sapiens
tgaatgaactggggtgtgtgtg

SEQ ID NO: 555096 - DNA, 22 bp, Homo sapiens
tagaagaaactgtacaagagaa

SEQ ID NO: 555097 - DNA, 22 bp, Homo sapiens
ggaaagctgagtggcagcttgc

SEQ ID NO: 555098 - DNA, 22 bp, Homo sapiens
tatataaatcctttcagactac

SEQ ID NO: 555099 - DNA, 22 bp, Homo sapiens
aggagatgtttcagagtgcccg

SEQ ID NO: 555100 - DNA, 22 bp, Homo sapiens
catctccagttagcagtactga

SEQ ID NO: 555101 - DNA, 22 bp, Homo sapiens
agtcatcgatcttccttttcct

SEQ ID NO: 555102 - DNA, 22 bp, Homo sapiens
tagttttctaattagggcttcc

SEQ ID NO: 555103 - DNA, 22 bp, Homo sapiens
agcactctacacagattgtcta

SEQ ID NO: 555104 - DNA, 22 bp, Homo sapiens
ttagacgctcttagactactgt

SEQ ID NO: 555105 - DNA, 22 bp, Homo sapiens
tctctatctgatctcttttgtg

SEQ ID NO: 555106 - DNA, 22 bp, Homo sapiens
tgcctaaggcactgggtatatg

SEQ ID NO: 555107 - DNA, 22 bp, Homo sapiens
tggtcataaggtctgcttagat

SEQ ID NO: 555108 - DNA, 22 bp, Homo sapiens
gccacgtgctgcgaagtgccct

SEQ ID NO: 555109 - DNA, 22 bp, Homo sapiens
tctctttcctggtttccttctg

SEQ ID NO: 555110 - DNA, 22 bp, Homo sapiens
tctgccatgttggaatttcaaa

SEQ ID NO: 555111 - DNA, 22 bp, Homo sapiens
tgtgagaggtgtacgcagaaat

SEQ ID NO: 555112 - DNA, 22 bp, Homo sapiens
tttgtcattttgtttctcggca

SEQ ID NO: 555113 - DNA, 22 bp, Homo sapiens
atgagattggggtgaggggtaa

SEQ ID NO: 555114 - DNA, 22 bp, Homo sapiens
cgttgcaaactgggagttggag

SEQ ID NO: 555115 - DNA, 22 bp, Homo sapiens
aaaacatcccttgagagaggat

SEQ ID NO: 555116 - DNA, 22 bp, Homo sapiens
tggctcagctgtctgtcagagc

SEQ ID NO: 555117 - DNA, 22 bp, Homo sapiens
caccagcctgatcatcaaagca

SEQ ID NO: 555118 - DNA, 22 bp, Homo sapiens
acacaatccccttcacaattgt

SEQ ID NO: 555119 - DNA, 22 bp, Homo sapiens
tgcctctggagctgaacactca

SEQ ID NO: 555120 - DNA, 22 bp, Homo sapiens
cctgtttattatcgtcatcagc

SEQ ID NO: 555121 - DNA, 22 bp, Homo sapiens
tcttaggcagttctttgtgctg

SEQ ID NO: 555122 - DNA, 22 bp, Homo sapiens
tattaatccaagccagtcattc

SEQ ID NO: 555123 - DNA, 22 bp, Homo sapiens
cgagaaaacatatccgtctcca

SEQ ID NO: 555124 - DNA, 22 bp, Homo sapiens
taaattgtctttctgtaagtgt

SEQ ID NO: 555125 - DNA, 22 bp, Homo sapiens
gactctccgaacctcactttcc

SEQ ID NO: 555126 - DNA, 22 bp, Homo sapiens
tcccaggaggcttcgcggtgag

SEQ ID NO: 555127 - DNA, 22 bp, Homo sapiens
ttccctgtcagtttcccctctg

SEQ ID NO: 555128 - DNA, 22 bp, Homo sapiens
tccttgtttccacagctgcagg

SEQ ID NO: 555129 - DNA, 22 bp, Homo sapiens
cctccctcccgccctccttttg

SEQ ID NO: 555130 - DNA, 22 bp, Homo sapiens
caaagagttgagggggcggggt

SEQ ID NO: 555131 - DNA, 22 bp, Homo sapiens
cctgggagctctcaacccgaat

SEQ ID NO: 555132 - DNA, 22 bp, Homo sapiens
tcctcggccgagcccggtcctc

SEQ ID NO: 555133 - DNA, 22 bp, Homo sapiens
aggcccattagatcctggccat

SEQ ID NO: 555134 - DNA, 22 bp, Homo sapiens
tccattcaaaaacacaatgcca

SEQ ID NO: 555135 - DNA, 22 bp, Homo sapiens
ccgccgattgacccgcgctccg

SEQ ID NO: 555136 - DNA, 22 bp, Homo sapiens
aagtaaatagcatcattacctg

SEQ ID NO: 555137 - DNA, 22 bp, Homo sapiens
tgactgctttcactcctggctg

SEQ ID NO: 555138 - DNA, 22 bp, Homo sapiens
tctcagaggagtcatacctaaa

SEQ ID NO: 555139 - DNA, 22 bp, Homo sapiens
tgatgtatataagacatctagt

SEQ ID NO: 555140 - DNA, 22 bp, Homo sapiens
cgcagcccggactggccggagg

SEQ ID NO: 555141 - DNA, 22 bp, Homo sapiens
ggacgacgtcacgggggcctct

SEQ ID NO: 555142 - DNA, 22 bp, Homo sapiens
gggagggagttctctgaggaag

SEQ ID NO: 555143 - DNA, 22 bp, Homo sapiens
agaaagaaggcaggacggttgt

SEQ ID NO: 555144 - DNA, 22 bp, Homo sapiens
ggaacttctaggaggcatggaa

SEQ ID NO: 555145 - DNA, 22 bp, Homo sapiens
ttggtgacaactggtttggagg

SEQ ID NO: 555146 - DNA, 22 bp, Homo sapiens
gggaagagaaatggggcagcag

SEQ ID NO: 555147 - DNA, 22 bp, Homo sapiens
caggatagcggttcccagtctg

SEQ ID NO: 555148 - DNA, 22 bp, Homo sapiens
gctcaaggcctgcatacaggaa

SEQ ID NO: 555149 - DNA, 22 bp, Homo sapiens
ttggggtgacagagatggggag

SEQ ID NO: 555150 - DNA, 22 bp, Homo sapiens
cttttgataactgctagagcca

SEQ ID NO: 555151 - DNA, 22 bp, Homo sapiens
gctgcccacggcaggcatgtgg

SEQ ID NO: 555152 - DNA, 22 bp, Homo sapiens
tctgcccacctagacccccgct

SEQ ID NO: 555153 - DNA, 22 bp, Homo sapiens
ttgttcagcagatgagcttgtt

SEQ ID NO: 555154 - DNA, 22 bp, Homo sapiens
gcacccctcactttccttctcc

SEQ ID NO: 555155 - DNA, 22 bp, Homo sapiens
caacctctgccaagtcttcaga

SEQ ID NO: 555156 - DNA, 22 bp, Homo sapiens
caattaggctttttaattaaaa

SEQ ID NO: 555157 - DNA, 22 bp, Homo sapiens
aagatgacaatgctaatgatga

SEQ ID NO: 555158 - DNA, 22 bp, Homo sapiens
tgccttggaccactgtgctccc

SEQ ID NO: 555159 - DNA, 22 bp, Homo sapiens
agtgtagactgagttctctttg

SEQ ID NO: 555160 - DNA, 22 bp, Homo sapiens
tccagctcctagccctgttgcc

SEQ ID NO: 555161 - DNA, 22 bp, Homo sapiens
aagccacgtaggtgggagacag

SEQ ID NO: 555162 - DNA, 22 bp, Homo sapiens
aggagaatctttgtcacttagt

SEQ ID NO: 555163 - DNA, 22 bp, Homo sapiens
tggggtcgggcaggagggccgg

SEQ ID NO: 555164 - DNA, 22 bp, Homo sapiens
tgagcagcagctgggaaattgc

SEQ ID NO: 555165 - DNA, 22 bp, Homo sapiens
tacctgggagggatacaaggcc

SEQ ID NO: 555166 - DNA, 22 bp, Homo sapiens
tgcccttctctgaggttcttgt

SEQ ID NO: 555167 - DNA, 22 bp, Homo sapiens
ttgctaaaattaaatgcttttg

SEQ ID NO: 555168 - DNA, 22 bp, Homo sapiens
ccacgtaggatggaattgtcta

SEQ ID NO: 555169 - DNA, 22 bp, Homo sapiens
tcttgactctccttcccatggc

SEQ ID NO: 555170 - DNA, 22 bp, Homo sapiens
gattcattctcaggcttcctgg

SEQ ID NO: 555171 - DNA, 22 bp, Homo sapiens
tccgcaatcaggctttcatatt

SEQ ID NO: 555172 - DNA, 22 bp, Homo sapiens
attgtttctgaatttgagaaaa

SEQ ID NO: 555173 - DNA, 22 bp, Homo sapiens
tctagactggcttctgctgtga

SEQ ID NO: 555174 - DNA, 22 bp, Homo sapiens
ccaaggcctaccctggggagac

SEQ ID NO: 555175 - DNA, 22 bp, Homo sapiens
atccagcacaccatgaggatgc

SEQ ID NO: 555176 - DNA, 22 bp, Homo sapiens
tgtatacagaagccatggattg

SEQ ID NO: 555177 - DNA, 22 bp, Homo sapiens
tcttcacctgctctacccactt

SEQ ID NO: 555178 - DNA, 22 bp, Homo sapiens
tctttttggctttttgcttcct

SEQ ID NO: 555179 - DNA, 22 bp, Homo sapiens
actgacaggagagcattttgac

SEQ ID NO: 555180 - DNA, 22 bp, Homo sapiens
ttttcttggcaaaaggttgagc

SEQ ID NO: 555181 - DNA, 22 bp, Homo sapiens
ttgggtgaaaacagtctctgat

SEQ ID NO: 555182 - DNA, 22 bp, Homo sapiens
tggtcaagtctgtggctggtgt

SEQ ID NO: 555183 - DNA, 22 bp, Homo sapiens
aatgatgaagcagaaaccttga

SEQ ID NO: 555184 - DNA, 22 bp, Homo sapiens
ctcagaatggttcacccatcct

SEQ ID NO: 555185 - DNA, 22 bp, Homo sapiens
tgtaggggtaggggaatggagc

SEQ ID NO: 555186 - DNA, 22 bp, Homo sapiens
tctgcacttgtttctctcttcc

SEQ ID NO: 555187 - DNA, 22 bp, Homo sapiens
ggagacgggagacaggatattt

SEQ ID NO: 555188 - DNA, 22 bp, Homo sapiens
ggggccaccggggaaaatctgc

SEQ ID NO: 555189 - DNA, 22 bp, Homo sapiens
tcacaggcatttaaagcactgt

SEQ ID NO: 555190 - DNA, 22 bp, Homo sapiens
tcactttacagctgtgtgccgt

SEQ ID NO: 555191 - DNA, 22 bp, Homo sapiens
gaatgttgctcggtgaacccct

SEQ ID NO: 555192 - DNA, 22 bp, Homo sapiens
gcctcctcattggtctgtgtcc

SEQ ID NO: 555193 - DNA, 22 bp, Homo sapiens
aaactttccttgcggaaattct

SEQ ID NO: 555194 - DNA, 22 bp, Homo sapiens
tgagacagcccaggctcggcac

SEQ ID NO: 555195 - DNA, 22 bp, Homo sapiens
gatggatgcatcacacaaaaca

SEQ ID NO: 555196 - DNA, 22 bp, Homo sapiens
atgcctggggaagactgttggg

SEQ ID NO: 555197 - DNA, 22 bp, Homo sapiens
gacttcctggtgccacagctca

SEQ ID NO: 555198 - DNA, 22 bp, Homo sapiens
agacagcagtggtgttttaaat

SEQ ID NO: 555199 - DNA, 22 bp, Homo sapiens
caatgatatacagtaagtggta

SEQ ID NO: 555200 - DNA, 22 bp, Homo sapiens
ccccagagtgtgtaggaaggta

SEQ ID NO: 555201 - DNA, 22 bp, Homo sapiens
tttgcataatcatttatctgaa

SEQ ID NO: 555202 - DNA, 22 bp, Homo sapiens
gtggctctttcatttactgtgt

SEQ ID NO: 555203 - DNA, 22 bp, Homo sapiens
ttggtactgatcccttcctagc

SEQ ID NO: 555204 - DNA, 22 bp, Homo sapiens
ccatctgtccagccaccagcgt

SEQ ID NO: 555205 - DNA, 22 bp, Homo sapiens
cctggcaaggcttgattgcttt

SEQ ID NO: 555206 - DNA, 22 bp, Homo sapiens
agtctctcaccttctcagaaaa

SEQ ID NO: 555207 - DNA, 22 bp, Homo sapiens
ttttccaagcactaaagggtct

SEQ ID NO: 555208 - DNA, 22 bp, Homo sapiens
tgtgctgtgggctaacaatcaa

SEQ ID NO: 555209 - DNA, 22 bp, Homo sapiens
atgtcctcagatctcaggctgc

SEQ ID NO: 555210 - DNA, 22 bp, Homo sapiens
caccaccgtgtagcgcttcttg

SEQ ID NO: 555211 - DNA, 22 bp, Homo sapiens
tcctgctcttcaggttctccca

SEQ ID NO: 555212 - DNA, 22 bp, Homo sapiens
gttatcaggagaggaggctcct

SEQ ID NO: 555213 - DNA, 22 bp, Homo sapiens
tacttagtatctggctttggac

SEQ ID NO: 555214 - DNA, 22 bp, Homo sapiens
ccttcaggaaaatgtccattta

SEQ ID NO: 555215 - DNA, 22 bp, Homo sapiens
tgtgtctgcctgcggtttcctt

SEQ ID NO: 555216 - DNA, 22 bp, Homo sapiens
aatcctttacatctgagactca

SEQ ID NO: 555217 - DNA, 22 bp, Homo sapiens
tgtgccagtcttgctggcagcc

SEQ ID NO: 555218 - DNA, 22 bp, Homo sapiens
tctttcagaatcatccttgagg

SEQ ID NO: 555219 - DNA, 22 bp, Homo sapiens
tggaagttatggtgacctctgt

SEQ ID NO: 555220 - DNA, 22 bp, Homo sapiens
tcagagagagcttctcttaaca

SEQ ID NO: 555221 - DNA, 22 bp, Homo sapiens
tgtagtccaaaggcacataccc

SEQ ID NO: 555222 - DNA, 22 bp, Homo sapiens
tggtgcatgctgggaacacagc

SEQ ID NO: 555223 - DNA, 22 bp, Homo sapiens
tatgtgcctttggactacatcg

SEQ ID NO: 555224 - DNA, 22 bp, Homo sapiens
ttgtaagtgctagagcgaggaa

SEQ ID NO: 555225 - DNA, 22 bp, Homo sapiens
gataatgagagagtgggatatt

SEQ ID NO: 555226 - DNA, 22 bp, Homo sapiens
cgatattcttccccactaatta

SEQ ID NO: 555227 - DNA, 22 bp, Homo sapiens
catgccccactgttaattgatt

SEQ ID NO: 555228 - DNA, 22 bp, Homo sapiens
ttcattactgctgtttgccact

SEQ ID NO: 555229 - DNA, 22 bp, Homo sapiens
tgttctaatattttcagctgtt

SEQ ID NO: 555230 - DNA, 22 bp, Homo sapiens
ttgcttgccttcctttatgatt

SEQ ID NO: 555231 - DNA, 22 bp, Homo sapiens
tccgtgcttccctcctgcctct

SEQ ID NO: 555232 - DNA, 22 bp, Homo sapiens
tctgggatctgtatttgggggg

SEQ ID NO: 555233 - DNA, 22 bp, Homo sapiens
tcttcaaatgcaccaggctgga

SEQ ID NO: 555234 - DNA, 22 bp, Homo sapiens
gagaggtggaaggtcagatgca

SEQ ID NO: 555235 - DNA, 22 bp, Homo sapiens
tcagatggggcacgcagaccct

SEQ ID NO: 555236 - DNA, 22 bp, Homo sapiens
tcaatatttgcctcaaagaata

SEQ ID NO: 555237 - DNA, 22 bp, Homo sapiens
tgatttgctggggttgctgggt

SEQ ID NO: 555238 - DNA, 22 bp, Homo sapiens
tccaggctgttgtttctctcct

SEQ ID NO: 555239 - DNA, 22 bp, Homo sapiens
cgccagtgggagtcgggcccag

SEQ ID NO: 555240 - DNA, 22 bp, Homo sapiens
tccacttgatgactgtctcgta

SEQ ID NO: 555241 - DNA, 22 bp, Homo sapiens
agcagtgggatatggtgtatgg

SEQ ID NO: 555242 - DNA, 22 bp, Homo sapiens
ggtctagtgtgagcgtagtcta

SEQ ID NO: 555243 - DNA, 22 bp, Homo sapiens
ccctgagagactgggcagggcc

SEQ ID NO: 555244 - DNA, 22 bp, Homo sapiens
aacctgagaccctggcagggtg

SEQ ID NO: 555245 - DNA, 22 bp, Homo sapiens
gattttctgctctatcagctca

SEQ ID NO: 555246 - DNA, 22 bp, Homo sapiens
tgtgaattccttctgtcatatc

SEQ ID NO: 555247 - DNA, 22 bp, Homo sapiens
tttgttattatttttctttttt

SEQ ID NO: 555248 - DNA, 22 bp, Homo sapiens
tatttggaaaagaattcccatg

SEQ ID NO: 555249 - DNA, 22 bp, Homo sapiens
gctggaatcatcatgggaatag

SEQ ID NO: 555250 - DNA, 22 bp, Homo sapiens
agtacatgttgttcaaaagcca

SEQ ID NO: 555251 - DNA, 22 bp, Homo sapiens
taatgtgtactcttcgggctca

SEQ ID NO: 555252 - DNA, 22 bp, Homo sapiens
tggtttgcaagctgaaggagaa

SEQ ID NO: 555253 - DNA, 22 bp, Homo sapiens
gccgaggcccgggccggttccc

SEQ ID NO: 555254 - DNA, 22 bp, Homo sapiens
aagagtgtgaggttgtgctttt

SEQ ID NO: 555255 - DNA, 22 bp, Homo sapiens
ccaggctgctctattcatgtag

SEQ ID NO: 555256 - DNA, 22 bp, Homo sapiens
tggggagagacaggtgtgagct

SEQ ID NO: 555257 - DNA, 22 bp, Homo sapiens
agggagggcaggtaggggaaaa

SEQ ID NO: 555258 - DNA, 22 bp, Homo sapiens
agaaggtcaggggtctgcaacc

SEQ ID NO: 555259 - DNA, 22 bp, Homo sapiens
tggaggctccaaggaatgttaa

SEQ ID NO: 555260 - DNA, 22 bp, Homo sapiens
cagagccggcctgctgtggagg

SEQ ID NO: 555261 - DNA, 22 bp, Homo sapiens
aggggtgaggagaggtggcaag

SEQ ID NO: 555262 - DNA, 22 bp, Homo sapiens
tgcacacttgacactcttgacc

SEQ ID NO: 555263 - DNA, 22 bp, Homo sapiens
gggtgtgcggctgagggcagag

SEQ ID NO: 555264 - DNA, 22 bp, Homo sapiens
tcccagaaactccacacccaca

SEQ ID NO: 555265 - DNA, 22 bp, Homo sapiens
tatgggtcgggatatatttagt

SEQ ID NO: 555266 - DNA, 22 bp, Homo sapiens
tcttggtgaattcctttatgtt

SEQ ID NO: 555267 - DNA, 22 bp, Homo sapiens
tctaagtgagatgagagggact

SEQ ID NO: 555268 - DNA, 22 bp, Homo sapiens
aggcgtggggaacctttcctga

SEQ ID NO: 555269 - DNA, 22 bp, Homo sapiens
tgatactgtgcccataaatatg

SEQ ID NO: 555270 - DNA, 22 bp, Homo sapiens
tgagggtctgggcactcctggg

SEQ ID NO: 555271 - DNA, 22 bp, Homo sapiens
taaggatgaaggcgctccctgt

SEQ ID NO: 555272 - DNA, 22 bp, Homo sapiens
tggaaaaaactggtgtgtgctt

SEQ ID NO: 555273 - DNA, 22 bp, Homo sapiens
taacactgggggttctgtgtca

SEQ ID NO: 555274 - DNA, 22 bp, Homo sapiens
acgtagccccccccagaccggc

SEQ ID NO: 555275 - DNA, 22 bp, Homo sapiens
ttggaatgtgtcttgggatata

SEQ ID NO: 555276 - DNA, 22 bp, Homo sapiens
gatgagggaggtgggtctgaat

SEQ ID NO: 555277 - DNA, 22 bp, Homo sapiens
acgaggttatgattggcatgac

SEQ ID NO: 555278 - DNA, 22 bp, Homo sapiens
tgctctctaggttctggtccct

SEQ ID NO: 555279 - DNA, 22 bp, Homo sapiens
tggagtctcctgctacctatgc

SEQ ID NO: 555280 - DNA, 22 bp, Homo sapiens
ttcccacacttgaagccctctg

SEQ ID NO: 555281 - DNA, 22 bp, Homo sapiens
catctctgtttggattcccagt

SEQ ID NO: 555282 - DNA, 22 bp, Homo sapiens
gccattgcttgcccaagtgtca

SEQ ID NO: 555283 - DNA, 22 bp, Homo sapiens
tgaccttcttcctctctggttt

SEQ ID NO: 555284 - DNA, 22 bp, Homo sapiens
gatgcgctctcgagctatgtgt

SEQ ID NO: 555285 - DNA, 22 bp, Homo sapiens
ttatgatgtcaccagaacccct

SEQ ID NO: 555286 - DNA, 22 bp, Homo sapiens
tatgaagcaaaactaatcagag

SEQ ID NO: 555287 - DNA, 22 bp, Homo sapiens
tctggttttggaggaaggatgc

SEQ ID NO: 555288 - DNA, 22 bp, Homo sapiens
ccacattacggtatatggctga

SEQ ID NO: 555289 - DNA, 22 bp, Homo sapiens
cagggttcctctctagcatttg

SEQ ID NO: 555290 - DNA, 22 bp, Homo sapiens
agagaaaagtgtgtgcagaggg

SEQ ID NO: 555291 - DNA, 22 bp, Homo sapiens
tttggaaacagttcactggttt

SEQ ID NO: 555292 - DNA, 22 bp, Homo sapiens
ttagattacagggtacctaaga

SEQ ID NO: 555293 - DNA, 22 bp, Homo sapiens
ttcacaggtgagtttgtgttcc

SEQ ID NO: 555294 - DNA, 22 bp, Homo sapiens
tccctactttttgtccacttct

SEQ ID NO: 555295 - DNA, 22 bp, Homo sapiens
tgggactgacatcatagacatg

SEQ ID NO: 555296 - DNA, 22 bp, Homo sapiens
ggtgctgccgtcagaaggcaca

SEQ ID NO: 555297 - DNA, 22 bp, Homo sapiens
ttccatgtctgtttccacattg

SEQ ID NO: 555298 - DNA, 22 bp, Homo sapiens
aaaacatgcaaattgtttgaaa

SEQ ID NO: 555299 - DNA, 22 bp, Homo sapiens
atattcaggagattctacctaa

SEQ ID NO: 555300 - DNA, 22 bp, Homo sapiens
atctccttcccacttcttagga

SEQ ID NO: 555301 - DNA, 22 bp, Homo sapiens
tgagatttggtagtttacctaa

SEQ ID NO: 555302 - DNA, 22 bp, Homo sapiens
cagtgcaggcctcaggctaggg

SEQ ID NO: 555303 - DNA, 22 bp, Homo sapiens
agggacgggacgcggtgcagtg

SEQ ID NO: 555304 - DNA, 22 bp, Homo sapiens
acccctggggcattgcaagtca

SEQ ID NO: 555305 - DNA, 22 bp, Homo sapiens
gtgggcacagtgggctggaggc

SEQ ID NO: 555306 - DNA, 22 bp, Homo sapiens
catgaatggagtggcctggtgc

SEQ ID NO: 555307 - DNA, 22 bp, Homo sapiens
gctggcattcttttgaataagc

SEQ ID NO: 555308 - DNA, 22 bp, Homo sapiens
taggctcaacttcagaatctgt

SEQ ID NO: 555309 - DNA, 22 bp, Homo sapiens
tgcccctgttgtaattaggtat

SEQ ID NO: 555310 - DNA, 22 bp, Homo sapiens
tcaggacacttctgaacttgga

SEQ ID NO: 555311 - DNA, 22 bp, Homo sapiens
tggtgaagaggggaaagaagaa

SEQ ID NO: 555312 - DNA, 22 bp, Homo sapiens
aggagctggccagcctcctggg

SEQ ID NO: 555313 - DNA, 22 bp, Homo sapiens
tatatgcacacatatatacttg

SEQ ID NO: 555314 - DNA, 22 bp, Homo sapiens
ttagctgacagtcctggttgtc

SEQ ID NO: 555315 - DNA, 22 bp, Homo sapiens
agctgagaaattctagctctgc

SEQ ID NO: 555316 - DNA, 22 bp, Homo sapiens
ttagtggaccgtgttacatacg

SEQ ID NO: 555317 - DNA, 22 bp, Homo sapiens
aggggaacaggcttggtgacga

SEQ ID NO: 555318 - DNA, 22 bp, Homo sapiens
tatttatacctggtctcattcc

SEQ ID NO: 555319 - DNA, 22 bp, Homo sapiens
taatgcccttatggttactact

SEQ ID NO: 555320 - DNA, 22 bp, Homo sapiens
aattaaggaccacctagggtgg

SEQ ID NO: 555321 - DNA, 22 bp, Homo sapiens
tgaaccttctcccttcctcaga

SEQ ID NO: 555322 - DNA, 22 bp, Homo sapiens
tcctttgccaccagtgttctca

SEQ ID NO: 555323 - DNA, 22 bp, Homo sapiens
gaaagagaagtggacgatgagg

SEQ ID NO: 555324 - DNA, 22 bp, Homo sapiens
atctaataaacatttactgagg

SEQ ID NO: 555325 - DNA, 22 bp, Homo sapiens
attagcagaagaggaactgtca

SEQ ID NO: 555326 - DNA, 22 bp, Homo sapiens
tactccagggtcaatggtggaa

SEQ ID NO: 555327 - DNA, 22 bp, Homo sapiens
tgatgatcagggcagaagcaga

SEQ ID NO: 555328 - DNA, 22 bp, Homo sapiens
cacggatccttcaccctggctt

SEQ ID NO: 555329 - DNA, 22 bp, Homo sapiens
tgtgcactgtgactggcagggg

SEQ ID NO: 555330 - DNA, 22 bp, Homo sapiens
gcctagaacttggcttgttttg

SEQ ID NO: 555331 - DNA, 22 bp, Homo sapiens
tgcacactacaactggcttgtg

SEQ ID NO: 555332 - DNA, 22 bp, Homo sapiens
caggcggtcattgctggagtgg

SEQ ID NO: 555333 - DNA, 22 bp, Homo sapiens
aatcgagggtgaactgtgctag

SEQ ID NO: 555334 - DNA, 22 bp, Homo sapiens
cctgggggggggagggtcctgc

SEQ ID NO: 555335 - DNA, 22 bp, Homo sapiens
tgtcagctgttcttttctctat

SEQ ID NO: 555336 - DNA, 22 bp, Homo sapiens
ggcctggggctggaggagttcc

SEQ ID NO: 555337 - DNA, 22 bp, Homo sapiens
tcaagtgttggatagcggttga

SEQ ID NO: 555338 - DNA, 22 bp, Homo sapiens
aaagtgcttccctttggactgt

SEQ ID NO: 555339 - DNA, 22 bp, Homo sapiens
gaatgaacagatgtgctctgaa

SEQ ID NO: 555340 - DNA, 22 bp, Homo sapiens
tggcccttctcttcctgggagc

SEQ ID NO: 555341 - DNA, 22 bp, Homo sapiens
cggtgaatgtgggtttttagtc

SEQ ID NO: 555342 - DNA, 22 bp, Homo sapiens
tctcccaatgaggccccgaagc

SEQ ID NO: 555343 - DNA, 22 bp, Homo sapiens
taagtgaagctatgataactag

SEQ ID NO: 555344 - DNA, 22 bp, Homo sapiens
ggaagagtctctggatagtagc

SEQ ID NO: 555345 - DNA, 22 bp, Homo sapiens
actggaatattgatttttcagt

SEQ ID NO: 555346 - DNA, 22 bp, Homo sapiens
tgcttcattgatttttgctggt

SEQ ID NO: 555347 - DNA, 22 bp, Homo sapiens
cattcctgctcgaaaagatgtg

SEQ ID NO: 555348 - DNA, 22 bp, Homo sapiens
ttctcttgccagcttctgccac

SEQ ID NO: 555349 - DNA, 22 bp, Homo sapiens
tcagaaatgctgtgatcccagg

SEQ ID NO: 555350 - DNA, 22 bp, Homo sapiens
tagaggtttcagaaagttttgc

SEQ ID NO: 555351 - DNA, 22 bp, Homo sapiens
ttcctccctcgggcctgattgg

SEQ ID NO: 555352 - DNA, 22 bp, Homo sapiens
tttggcaatggatggtcatcta

SEQ ID NO: 555353 - DNA, 22 bp, Homo sapiens
cagactccagtttgagccttta

SEQ ID NO: 555354 - DNA, 22 bp, Homo sapiens
cacccacgactgtaaactccaa

SEQ ID NO: 555355 - DNA, 22 bp, Homo sapiens
aagtcttcactaaaatcacata

SEQ ID NO: 555356 - DNA, 22 bp, Homo sapiens
tgctgggtggggtgggggaacc

SEQ ID NO: 555357 - DNA, 22 bp, Homo sapiens
tgtgtctccttacattttgtgt

SEQ ID NO: 555358 - DNA, 22 bp, Homo sapiens
taatactgtctggtaaaaccgt

SEQ ID NO: 555359 - DNA, 22 bp, Homo sapiens
tctctctctcttacctctatct

SEQ ID NO: 555360 - DNA, 22 bp, Homo sapiens
cagagtggtactgtggggggcc

SEQ ID NO: 555361 - DNA, 22 bp, Homo sapiens
aggtgacatgatctcttgggtg

SEQ ID NO: 555362 - DNA, 22 bp, Homo sapiens
cagaaaggttgtttatggttgt

SEQ ID NO: 555363 - DNA, 22 bp, Homo sapiens
agacaagcaagggggttgcttt

SEQ ID NO: 555364 - DNA, 22 bp, Homo sapiens
ggaggaggacacttgagcctcc

SEQ ID NO: 555365 - DNA, 22 bp, Homo sapiens
ggtgctgtttatgggagcaggg

SEQ ID NO: 555366 - DNA, 22 bp, Homo sapiens
gatggggaaagggagggaacga

SEQ ID NO: 555367 - DNA, 22 bp, Homo sapiens
tctttgaagcactgtgagctcc

SEQ ID NO: 555368 - DNA, 22 bp, Homo sapiens
cagcagtgctctagagcgtgcc

SEQ ID NO: 555369 - DNA, 22 bp, Homo sapiens
aggtttatttcattggattgtt

SEQ ID NO: 555370 - DNA, 22 bp, Homo sapiens
cagtttgctgcacagatatttg

SEQ ID NO: 555371 - DNA, 22 bp, Homo sapiens
gggttctttaagtgcctgtgat

SEQ ID NO: 555372 - DNA, 22 bp, Homo sapiens
gtgtgctgcagattctactgaa

SEQ ID NO: 555373 - DNA, 22 bp, Homo sapiens
tctcagttactctccctggtac

SEQ ID NO: 555374 - DNA, 22 bp, Homo sapiens
tacagctaagaatttcatcttt

SEQ ID NO: 555375 - DNA, 22 bp, Homo sapiens
aggcaactcctggccactgttc

SEQ ID NO: 555376 - DNA, 22 bp, Homo sapiens
tctgtcactgacccgggcaagt

SEQ ID NO: 555377 - DNA, 22 bp, Homo sapiens
tctgctgagagtttctgactga

SEQ ID NO: 555378 - DNA, 22 bp, Homo sapiens
atttttattgagagccttgatg

SEQ ID NO: 555379 - DNA, 22 bp, Homo sapiens
gacaaccattgttttagtatcc

SEQ ID NO: 555380 - DNA, 22 bp, Homo sapiens
tcccttccgcgtagctatgtat

SEQ ID NO: 555381 - DNA, 22 bp, Homo sapiens
gtggcaggccatcctacaagca

SEQ ID NO: 555382 - DNA, 22 bp, Homo sapiens
cacctgcttgccagggccgatc

SEQ ID NO: 555383 - DNA, 22 bp, Homo sapiens
gaaggacaggcaggtgaggggc

SEQ ID NO: 555384 - DNA, 22 bp, Homo sapiens
agttgtagtttcggatgcgttc

SEQ ID NO: 555385 - DNA, 22 bp, Homo sapiens
cgggcggtgtgggcgcgtcggg

SEQ ID NO: 555386 - DNA, 22 bp, Homo sapiens
atgtgtgggggaagggaagtct

SEQ ID NO: 555387 - DNA, 22 bp, Homo sapiens
tctacccacagtttgtgaggag

SEQ ID NO: 555388 - DNA, 22 bp, Homo sapiens
tagagtcagcaggtggtaatca

SEQ ID NO: 555389 - DNA, 22 bp, Homo sapiens
ctgctcctcaacccaccttccc

SEQ ID NO: 555390 - DNA, 22 bp, Homo sapiens
tcgaaagtggcaggtatccagg

SEQ ID NO: 555391 - DNA, 22 bp, Homo sapiens
aactacctctatagccctgcta

SEQ ID NO: 555392 - DNA, 22 bp, Homo sapiens
cacatggccaaaacagagaaga

SEQ ID NO: 555393 - DNA, 22 bp, Homo sapiens
tcctggtccagactcttctcct

SEQ ID NO: 555394 - DNA, 22 bp, Homo sapiens
ttgttgtgcttacaacagctgt

SEQ ID NO: 555395 - DNA, 22 bp, Homo sapiens
tcctgtctctgagtaacacctt

SEQ ID NO: 555396 - DNA, 22 bp, Homo sapiens
cacatcatcaactgtgcctgca

SEQ ID NO: 555397 - DNA, 22 bp, Homo sapiens
ctctaccctcagttatgtgtgt

SEQ ID NO: 555398 - DNA, 22 bp, Homo sapiens
ctcacagtggctggctgcccct

SEQ ID NO: 555399 - DNA, 22 bp, Homo sapiens
gatggtgctgggtgctggcctg

SEQ ID NO: 555400 - DNA, 22 bp, Homo sapiens
accattagctatctctctgacc

SEQ ID NO: 555401 - DNA, 22 bp, Homo sapiens
atgtgggtacctctgaaagggg

SEQ ID NO: 555402 - DNA, 22 bp, Homo sapiens
acaggaaggacccaggccccag

SEQ ID NO: 555403 - DNA, 22 bp, Homo sapiens
aatgggccccttttgacctgaa

SEQ ID NO: 555404 - DNA, 22 bp, Homo sapiens
tgggaagagagtgggagagaaa

SEQ ID NO: 555405 - DNA, 22 bp, Homo sapiens
agttcctggtgtacctcctccc

SEQ ID NO: 555406 - DNA, 22 bp, Homo sapiens
ttggcaacatttgttggggaaa

SEQ ID NO: 555407 - DNA, 22 bp, Homo sapiens
cccctctccggaatcccctatc

SEQ ID NO: 555408 - DNA, 22 bp, Homo sapiens
tcctgctgcccgccctctgggg

SEQ ID NO: 555409 - DNA, 22 bp, Homo sapiens
ttggatattgcttggaggctct

SEQ ID NO: 555410 - DNA, 22 bp, Homo sapiens
gccccagtgtcctagaaacgtt

SEQ ID NO: 555411 - DNA, 22 bp, Homo sapiens
tgggccagggcctctggagctg

SEQ ID NO: 555412 - DNA, 22 bp, Homo sapiens
tgcttttctgggaggaccagaa

SEQ ID NO: 555413 - DNA, 22 bp, Homo sapiens
tgaggttttggtgaaggctcct

SEQ ID NO: 555414 - DNA, 22 bp, Homo sapiens
tggtgtagccgccaagcggagg

SEQ ID NO: 555415 - DNA, 22 bp, Homo sapiens
tgactgattgcttcttgtgttc

SEQ ID NO: 555416 - DNA, 22 bp, Homo sapiens
caggctgttggctccagggttc

SEQ ID NO: 555417 - DNA, 22 bp, Homo sapiens
ggaggccttgtgaaggaggctg

SEQ ID NO: 555418 - DNA, 22 bp, Homo sapiens
tcagttcctcaggctcagattt

SEQ ID NO: 555419 - DNA, 22 bp, Homo sapiens
catcctcccagctctgctccca

SEQ ID NO: 555420 - DNA, 22 bp, Homo sapiens
taaccatacacattgtttccgg

SEQ ID NO: 555421 - DNA, 22 bp, Homo sapiens
aacaccccatctttaattcatg

SEQ ID NO: 555422 - DNA, 22 bp, Homo sapiens
gcccagtgtcccatcacagtgc

SEQ ID NO: 555423 - DNA, 22 bp, Homo sapiens
ggtgccatgtatatgtcaaatg

SEQ ID NO: 555424 - DNA, 22 bp, Homo sapiens
tcatagctaggccttcttaagt

SEQ ID NO: 555425 - DNA, 22 bp, Homo sapiens
agggctgggaggggcagtgggt

SEQ ID NO: 555426 - DNA, 22 bp, Homo sapiens
cccagaaagagtaaagtgctcg

SEQ ID NO: 555427 - DNA, 22 bp, Homo sapiens
tttggccttaaaataagacagg

SEQ ID NO: 555428 - DNA, 22 bp, Homo sapiens
tatgttttatttttgtttatga

SEQ ID NO: 555429 - DNA, 22 bp, Homo sapiens
gggagggagggacttttgtgga

SEQ ID NO: 555430 - DNA, 22 bp, Homo sapiens
actgtactcttctagccatctg

SEQ ID NO: 555431 - DNA, 22 bp, Homo sapiens
cagtgtaatgagttgggagagc

SEQ ID NO: 555432 - DNA, 22 bp, Homo sapiens
tcagctcagctgattttgttgc

SEQ ID NO: 555433 - DNA, 22 bp, Homo sapiens
taggggagggcctctgacaccc

SEQ ID NO: 555434 - DNA, 22 bp, Homo sapiens
tggataggttatatcgtgggtg

SEQ ID NO: 555435 - DNA, 22 bp, Homo sapiens
tgtcggtgtggctttttatttg

SEQ ID NO: 555436 - DNA, 22 bp, Homo sapiens
aattgtttggctggatgtcctg

SEQ ID NO: 555437 - DNA, 22 bp, Homo sapiens
tagtactgtttgtaattgttga

SEQ ID NO: 555438 - DNA, 22 bp, Homo sapiens
aggagggtatcaggtgaggttg

SEQ ID NO: 555439 - DNA, 22 bp, Homo sapiens
tggggcctccccaacctgaccc

SEQ ID NO: 555440 - DNA, 22 bp, Homo sapiens
tctttgctcacccttccacctg

SEQ ID NO: 555441 - DNA, 22 bp, Homo sapiens
cgtgaagtctccctgccaggat

SEQ ID NO: 555442 - DNA, 22 bp, Homo sapiens
tgctttttgagggaagggagga

SEQ ID NO: 555443 - DNA, 22 bp, Homo sapiens
tgttggtcacaaatcaatgcta

SEQ ID NO: 555444 - DNA, 22 bp, Homo sapiens
ggaaagcactgttttttgtgat

SEQ ID NO: 555445 - DNA, 22 bp, Homo sapiens
tgtccagcctgcccacacccac

SEQ ID NO: 555446 - DNA, 22 bp, Homo sapiens
ctctgagtacataatggccctc

SEQ ID NO: 555447 - DNA, 22 bp, Homo sapiens
gtccaatcatttatggccaggg

SEQ ID NO: 555448 - DNA, 22 bp, Homo sapiens
gaagcaaccatccagaggaaaa

SEQ ID NO: 555449 - DNA, 22 bp, Homo sapiens
cgtcttcatgaagctcctaagg

SEQ ID NO: 555450 - DNA, 22 bp, Homo sapiens
tctgactttggcaagttcttca

SEQ ID NO: 555451 - DNA, 22 bp, Homo sapiens
ttccagggaactcctggagagt

SEQ ID NO: 555452 - DNA, 22 bp, Homo sapiens
aggcaaaggactggaaaacact

SEQ ID NO: 555453 - DNA, 22 bp, Homo sapiens
tgagggtgtgcagtgtgcggtg

SEQ ID NO: 555454 - DNA, 22 bp, Homo sapiens
cagcattgctgagccttaccat

SEQ ID NO: 555455 - DNA, 22 bp, Homo sapiens
tggacaagtgtggttgtgagat

SEQ ID NO: 555456 - DNA, 22 bp, Homo sapiens
aaggtcaaggccaaaagagtgg

SEQ ID NO: 555457 - DNA, 22 bp, Homo sapiens
tattatttaagtgtgcacaata

SEQ ID NO: 555458 - DNA, 22 bp, Homo sapiens
ttctgtgagatgcagacttgac

SEQ ID NO: 555459 - DNA, 22 bp, Homo sapiens
gacttccttcctgccagtggct

SEQ ID NO: 555460 - DNA, 22 bp, Homo sapiens
cagtcaggccccttagggagcc

SEQ ID NO: 555461 - DNA, 22 bp, Homo sapiens
ttaggaggtgaaggtcagtgtt

SEQ ID NO: 555462 - DNA, 22 bp, Homo sapiens
ggaagatgttccagtctctttg

SEQ ID NO: 555463 - DNA, 22 bp, Homo sapiens
gtcaaattttagagcttaagcc

SEQ ID NO: 555464 - DNA, 22 bp, Homo sapiens
tgtggctagttagctaatgctt

SEQ ID NO: 555465 - DNA, 22 bp, Homo sapiens
ccacattctgcggtggagagag

SEQ ID NO: 555466 - DNA, 22 bp, Homo sapiens
gggttcctccttcttctctttt

SEQ ID NO: 555467 - DNA, 22 bp, Homo sapiens
tcagcagtggtcagcccaggag

SEQ ID NO: 555468 - DNA, 22 bp, Homo sapiens
cttcatctatagtagctattca

SEQ ID NO: 555469 - DNA, 22 bp, Homo sapiens
gttgtcagtgtccggaccctca

SEQ ID NO: 555470 - DNA, 22 bp, Homo sapiens
tgtgccaggaagagcctgcatg

SEQ ID NO: 555471 - DNA, 22 bp, Homo sapiens
agcccaggagaatagataatat

SEQ ID NO: 555472 - DNA, 22 bp, Homo sapiens
cctttatccagctttgtgtgcc

SEQ ID NO: 555473 - DNA, 22 bp, Homo sapiens
tccctggggccagcccacacac

SEQ ID NO: 555474 - DNA, 22 bp, Homo sapiens
gaggttttcatgtttgtctctt

SEQ ID NO: 555475 - DNA, 22 bp, Homo sapiens
gggtggaatgtggtgggagaat

SEQ ID NO: 555476 - DNA, 22 bp, Homo sapiens
tgctaggagtgtgcttccatgg

SEQ ID NO: 555477 - DNA, 22 bp, Homo sapiens
cggctggctgatggatgcaggc

SEQ ID NO: 555478 - DNA, 22 bp, Homo sapiens
tggatttgaggagtaaggggat

SEQ ID NO: 555479 - DNA, 22 bp, Homo sapiens
tccgtgctttcagggtcgctgt

SEQ ID NO: 555480 - DNA, 22 bp, Homo sapiens
ctaactatgactattatgccta

SEQ ID NO: 555481 - DNA, 22 bp, Homo sapiens
gaaatcatatggaagtttaact

SEQ ID NO: 555482 - DNA, 22 bp, Homo sapiens
gcctctaggatggggagggaaa

SEQ ID NO: 555483 - DNA, 22 bp, Homo sapiens
tcccctagatacgaatttgtga

SEQ ID NO: 555484 - DNA, 22 bp, Homo sapiens
tggggagctttgctagttcagc

SEQ ID NO: 555485 - DNA, 22 bp, Homo sapiens
tcagcatttgtggaatcagcac

SEQ ID NO: 555486 - DNA, 22 bp, Homo sapiens
actgttcacaaaattctggcca

SEQ ID NO: 555487 - DNA, 22 bp, Homo sapiens
gtctccaccgacttgcaacaca

SEQ ID NO: 555488 - DNA, 22 bp, Homo sapiens
tataatgatttcttatgctcat

SEQ ID NO: 555489 - DNA, 22 bp, Homo sapiens
tccacgcttaggtggagcgagg

SEQ ID NO: 555490 - DNA, 22 bp, Homo sapiens
ttaactggtaagatgtacgtgt

SEQ ID NO: 555491 - DNA, 22 bp, Homo sapiens
gctccttcaccccccacctcat

SEQ ID NO: 555492 - DNA, 22 bp, Homo sapiens
ttatgccagatctgaagcaact

SEQ ID NO: 555493 - DNA, 22 bp, Homo sapiens
gcagtatgttacaagtaaatat

SEQ ID NO: 555494 - DNA, 22 bp, Homo sapiens
ggcggtcgtggactacaactcc

SEQ ID NO: 555495 - DNA, 22 bp, Homo sapiens
gtgtttgttatctatctgttgt

SEQ ID NO: 555496 - DNA, 22 bp, Homo sapiens
ttagcattttttaccttgttgg

SEQ ID NO: 555497 - DNA, 22 bp, Homo sapiens
aataattagttttgaaactata

SEQ ID NO: 555498 - DNA, 22 bp, Homo sapiens
agagtccctgggtctgttccat

SEQ ID NO: 555499 - DNA, 22 bp, Homo sapiens
aatcatagaggaaaatccgcat

SEQ ID NO: 555500 - DNA, 22 bp, Homo sapiens
aaacgtggatattccttctatg

SEQ ID NO: 555501 - DNA, 22 bp, Homo sapiens
gagaggaagaaggtctggcctt

SEQ ID NO: 555502 - DNA, 22 bp, Homo sapiens
ttttgtcttctacacttaaaaa

SEQ ID NO: 555503 - DNA, 22 bp, Homo sapiens
ccccacacaggcctcggggagg

SEQ ID NO: 555504 - DNA, 22 bp, Homo sapiens
ttctatcctcctgtactcatca

SEQ ID NO: 555505 - DNA, 22 bp, Homo sapiens
cttacgagaccagagccggcag

SEQ ID NO: 555506 - DNA, 22 bp, Homo sapiens
agagcttaattagattaagctg

SEQ ID NO: 555507 - DNA, 22 bp, Homo sapiens
tgcagggatggaggggatgggg

SEQ ID NO: 555508 - DNA, 22 bp, Homo sapiens
tttcctcatattcattcaggag

SEQ ID NO: 555509 - DNA, 22 bp, Homo sapiens
ccatgtttctgaccaccctctt

SEQ ID NO: 555510 - DNA, 22 bp, Homo sapiens
ttctaaaggaggcagtatagat

SEQ ID NO: 555511 - DNA, 22 bp, Homo sapiens
caggagttgtccgtattctgca

SEQ ID NO: 555512 - DNA, 22 bp, Homo sapiens
cagccagggagggagcacagcc

SEQ ID NO: 555513 - DNA, 22 bp, Homo sapiens
tcagtgcatttggtgggtactg

SEQ ID NO: 555514 - DNA, 22 bp, Homo sapiens
tggggttcctgtgccaagggct

SEQ ID NO: 555515 - DNA, 22 bp, Homo sapiens
tgaagatagatggattccctta

SEQ ID NO: 555516 - DNA, 22 bp, Homo sapiens
ggaatatctcatagggctgttg

SEQ ID NO: 555517 - DNA, 22 bp, Homo sapiens
ccccaccttccctagaatgggc

SEQ ID NO: 555518 - DNA, 22 bp, Homo sapiens
agcgggagtgtgtgtttgtcct

SEQ ID NO: 555519 - DNA, 22 bp, Homo sapiens
tgcatgacctggatgacaacga

SEQ ID NO: 555520 - DNA, 22 bp, Homo sapiens
tgagagctgatttaactcattt

SEQ ID NO: 555521 - DNA, 22 bp, Homo sapiens
tattttgtttcttctttaagag

SEQ ID NO: 555522 - DNA, 22 bp, Homo sapiens
gcaggaggtagcgcacagccat

SEQ ID NO: 555523 - DNA, 22 bp, Homo sapiens
caagtgtttttcatgaccctca

SEQ ID NO: 555524 - DNA, 22 bp, Homo sapiens
tagttttcagaattggagcctc

SEQ ID NO: 555525 - DNA, 22 bp, Homo sapiens
taaggaatggagaagttcttca

SEQ ID NO: 555526 - DNA, 22 bp, Homo sapiens
tgaggatttaatgggactcatt

SEQ ID NO: 555527 - DNA, 22 bp, Homo sapiens
cctattcttatatgtgctccag

SEQ ID NO: 555528 - DNA, 22 bp, Homo sapiens
tgaagtgctggctgttttgctg

SEQ ID NO: 555529 - DNA, 22 bp, Homo sapiens
taaagtttttgacagtcttgaa

SEQ ID NO: 555530 - DNA, 22 bp, Homo sapiens
ttctctttgggtctcagtttcc

SEQ ID NO: 555531 - DNA, 22 bp, Homo sapiens
tggctgggtgagtgtcactgtg

SEQ ID NO: 555532 - DNA, 22 bp, Homo sapiens
catcaaggctctcaataaaaat

SEQ ID NO: 555533 - DNA, 22 bp, Homo sapiens
aggttccctgtcccctttctct

SEQ ID NO: 555534 - DNA, 22 bp, Homo sapiens
tggatgtcacacccatgatgct

SEQ ID NO: 555535 - DNA, 22 bp, Homo sapiens
tgctcacttgtcctcctccatg

SEQ ID NO: 555536 - DNA, 22 bp, Homo sapiens
tcctgtggccatgtgtggtcat

SEQ ID NO: 555537 - DNA, 22 bp, Homo sapiens
acagcttagcttctgcagagct

SEQ ID NO: 555538 - DNA, 22 bp, Homo sapiens
gaggcagagaagggacaggaaa

SEQ ID NO: 555539 - DNA, 22 bp, Homo sapiens
tgtctcatttcagggcagaggg

SEQ ID NO: 555540 - DNA, 22 bp, Homo sapiens
tctcagctacttctttggaagg

SEQ ID NO: 555541 - DNA, 22 bp, Homo sapiens
caggccggcaggctgggctggt

SEQ ID NO: 555542 - DNA, 22 bp, Homo sapiens
ccgaggcaggacaactggaatg

SEQ ID NO: 555543 - DNA, 22 bp, Homo sapiens
ttaaagctaccgaaagttgggc

SEQ ID NO: 555544 - DNA, 22 bp, Homo sapiens
ggggagggggcaggcaaaggcc

SEQ ID NO: 555545 - DNA, 22 bp, Homo sapiens
tttgctgccttgcttctaacca

SEQ ID NO: 555546 - DNA, 22 bp, Homo sapiens
atggagtccattggctgtcagg

SEQ ID NO: 555547 - DNA, 22 bp, Homo sapiens
tgtacgagtacatcctcatcat

SEQ ID NO: 555548 - DNA, 22 bp, Homo sapiens
gccagttaaaactcccttgaaa

SEQ ID NO: 555549 - DNA, 22 bp, Homo sapiens
cactggttggtaaatactatga

SEQ ID NO: 555550 - DNA, 22 bp, Homo sapiens
aaatgtctgattgtgtatgcaa

SEQ ID NO: 555551 - DNA, 22 bp, Homo sapiens
gatcaaataagctgtataagag

SEQ ID NO: 555552 - DNA, 22 bp, Homo sapiens
tgttatcattaggctcaacatg

SEQ ID NO: 555553 - DNA, 22 bp, Homo sapiens
actggtatctcttcctctgggt

SEQ ID NO: 555554 - DNA, 22 bp, Homo sapiens
ggattcagagaaggaatggata

SEQ ID NO: 555555 - DNA, 22 bp, Homo sapiens
tcatggcttctgtcttggaaac

SEQ ID NO: 555556 - DNA, 22 bp, Homo sapiens
gactccagaaacagtatcagtc

SEQ ID NO: 555557 - DNA, 22 bp, Homo sapiens
gtaggactcagatgagggaatg

SEQ ID NO: 555558 - DNA, 22 bp, Homo sapiens
tggggactcaaggatggatctt

SEQ ID NO: 555559 - DNA, 22 bp, Homo sapiens
gaggctgctctattcatgtagg

SEQ ID NO: 555560 - DNA, 22 bp, Homo sapiens
taatgaagctctcccagctttc

SEQ ID NO: 555561 - DNA, 22 bp, Homo sapiens
gcaagagggatgggggagagga

SEQ ID NO: 555562 - DNA, 22 bp, Homo sapiens
catgctgactaccaccagacgc

SEQ ID NO: 555563 - DNA, 22 bp, Homo sapiens
ggtttaggtgaattttgctgca

SEQ ID NO: 555564 - DNA, 22 bp, Homo sapiens
tctggtcccagctctgctgctc

SEQ ID NO: 555565 - DNA, 22 bp, Homo sapiens
ggtttaaatcccatgggctgtt

SEQ ID NO: 555566 - DNA, 22 bp, Homo sapiens
catcaagtatgactagtgggac

SEQ ID NO: 555567 - DNA, 22 bp, Homo sapiens
caggagagcggggatgtaggca

SEQ ID NO: 555568 - DNA, 22 bp, Homo sapiens
taattttagatctggtctgctt

SEQ ID NO: 555569 - DNA, 22 bp, Homo sapiens
cagacaggcagcaggagggagt

SEQ ID NO: 555570 - DNA, 22 bp, Homo sapiens
gctccagtctcgacgttcccgg

SEQ ID NO: 555571 - DNA, 22 bp, Homo sapiens
cacatggccgaaacagagaagt

SEQ ID NO: 555572 - DNA, 22 bp, Homo sapiens
tgtaggggccccccggggttgg

SEQ ID NO: 555573 - DNA, 22 bp, Homo sapiens
tggggaaatgggttctcttgat

SEQ ID NO: 555574 - DNA, 22 bp, Homo sapiens
tgagagcctattgtaggcacat

SEQ ID NO: 555575 - DNA, 22 bp, Homo sapiens
agtgatatattagtgcaataca

SEQ ID NO: 555576 - DNA, 22 bp, Homo sapiens
ttgaaataagaggattgctaat

SEQ ID NO: 555577 - DNA, 22 bp, Homo sapiens
cattcctctttgtccctttgct

SEQ ID NO: 555578 - DNA, 22 bp, Homo sapiens
cactctgctgactttcaagatt

SEQ ID NO: 555579 - DNA, 22 bp, Homo sapiens
gagaaaactggagcctggggtt

SEQ ID NO: 555580 - DNA, 22 bp, Homo sapiens
ttgcctcatttcccttctcctt

SEQ ID NO: 555581 - DNA, 22 bp, Homo sapiens
taccagcgcgttttcagtttca

SEQ ID NO: 555582 - DNA, 22 bp, Homo sapiens
gacagtctggctggctttgtca

SEQ ID NO: 555583 - DNA, 22 bp, Homo sapiens
ttgcaagccttgggtgtgggag

SEQ ID NO: 555584 - DNA, 22 bp, Homo sapiens
tacaatgccatctatctttaag

SEQ ID NO: 555585 - DNA, 22 bp, Homo sapiens
taaattcttgagccttcttctt

SEQ ID NO: 555586 - DNA, 22 bp, Homo sapiens
tccgctggggctgtttcttaac

SEQ ID NO: 555587 - DNA, 22 bp, Homo sapiens
tgtcctctcagagttgtctgcc

SEQ ID NO: 555588 - DNA, 22 bp, Homo sapiens
tatatatgcacacatatatact

SEQ ID NO: 555589 - DNA, 22 bp, Homo sapiens
agcccttcctgatggcttcctg

SEQ ID NO: 555590 - DNA, 22 bp, Homo sapiens
tttccccctggtttggcacata

SEQ ID NO: 555591 - DNA, 22 bp, Homo sapiens
catttatgtgtgtacattgcat

SEQ ID NO: 555592 - DNA, 22 bp, Homo sapiens
ttgttttggagatggatttatg

SEQ ID NO: 555593 - DNA, 22 bp, Homo sapiens
taacctcaagctatggaaaaaa

SEQ ID NO: 555594 - DNA, 22 bp, Homo sapiens
tctggcagtgggccacagtggt

SEQ ID NO: 555595 - DNA, 22 bp, Homo sapiens
aacattcaaagcaggatgtgtg

SEQ ID NO: 555596 - DNA, 22 bp, Homo sapiens
tgcccctccctggtggcatcct

SEQ ID NO: 555597 - DNA, 22 bp, Homo sapiens
tttgcgggtggacgagggtcta

SEQ ID NO: 555598 - DNA, 22 bp, Homo sapiens
aaaggctttgctgggctttgtt

SEQ ID NO: 555599 - DNA, 22 bp, Homo sapiens
ttccattccactgctcccttgg

SEQ ID NO: 555600 - DNA, 22 bp, Homo sapiens
aaatgtctctttactttgtgat

SEQ ID NO: 555601 - DNA, 22 bp, Homo sapiens
cctgaggagtgaatgggcctca

SEQ ID NO: 555602 - DNA, 22 bp, Homo sapiens
ccttgtagacctgccccacaga

SEQ ID NO: 555603 - DNA, 22 bp, Homo sapiens
gagcacctcctatattccgggc

SEQ ID NO: 555604 - DNA, 22 bp, Homo sapiens
tctaccaacagctattgatatc

SEQ ID NO: 555605 - DNA, 22 bp, Homo sapiens
taggccccaagtctggggggtc

SEQ ID NO: 555606 - DNA, 22 bp, Homo sapiens
ttgcttatgccaggtgagagag

SEQ ID NO: 555607 - DNA, 22 bp, Homo sapiens
tgcagagagtagtaagtgaaag

SEQ ID NO: 555608 - DNA, 22 bp, Homo sapiens
tagtagtagcttgaaaaaactc

SEQ ID NO: 555609 - DNA, 22 bp, Homo sapiens
tgggtgagcagctgcagctgag

SEQ ID NO: 555610 - DNA, 22 bp, Homo sapiens
tatagtatataggacacagaga

SEQ ID NO: 555611 - DNA, 22 bp, Homo sapiens
tcaaccccgtatgtcctctgaa

SEQ ID NO: 555612 - DNA, 22 bp, Homo sapiens
gccctgatgtgtgtcggctgga

SEQ ID NO: 555613 - DNA, 22 bp, Homo sapiens
aacttactgagggctttgaagg

SEQ ID NO: 555614 - DNA, 22 bp, Homo sapiens
tacaggtttatcattaatatta

SEQ ID NO: 555615 - DNA, 22 bp, Homo sapiens
tctgtgtctgttggtcttactt

SEQ ID NO: 555616 - DNA, 22 bp, Homo sapiens
gcactgccgttttctaactata

SEQ ID NO: 555617 - DNA, 22 bp, Homo sapiens
ggtgtgtgcgttagaatgcagc

SEQ ID NO: 555618 - DNA, 22 bp, Homo sapiens
cctttcaaactagcagcacctc

SEQ ID NO: 555619 - DNA, 22 bp, Homo sapiens
tgtctctttcttcccttctccc

SEQ ID NO: 555620 - DNA, 22 bp, Homo sapiens
tctcacaatgggacggataact

SEQ ID NO: 555621 - DNA, 22 bp, Homo sapiens
ttgtctttccccctgttttctt

SEQ ID NO: 555622 - DNA, 22 bp, Homo sapiens
gtagcctttctctgatgcacag

SEQ ID NO: 555623 - DNA, 22 bp, Homo sapiens
ttagaggagcaccgagactggg

SEQ ID NO: 555624 - DNA, 22 bp, Homo sapiens
gacagtaacctttctggtcttt

SEQ ID NO: 555625 - DNA, 22 bp, Homo sapiens
tgactgattacattacatattg

SEQ ID NO: 555626 - DNA, 22 bp, Homo sapiens
aaatatcacagaatgtcctgta

SEQ ID NO: 555627 - DNA, 22 bp, Homo sapiens
gatgggagtttgttattcagtg

SEQ ID NO: 555628 - DNA, 22 bp, Homo sapiens
gtagctctgaggcctgggtctg

SEQ ID NO: 555629 - DNA, 22 bp, Homo sapiens
tgcagaaaacctttcctttccc

SEQ ID NO: 555630 - DNA, 22 bp, Homo sapiens
tagacactattggttgctaatt

SEQ ID NO: 555631 - DNA, 22 bp, Homo sapiens
cctcacatttacacagtggcag

SEQ ID NO: 555632 - DNA, 22 bp, Homo sapiens
cagccaaacccaaactccagac

SEQ ID NO: 555633 - DNA, 22 bp, Homo sapiens
gctggcatgaagctcctgtgtg

SEQ ID NO: 555634 - DNA, 22 bp, Homo sapiens
aggagggttctcagaggatcct

SEQ ID NO: 555635 - DNA, 22 bp, Homo sapiens
tggcactttacttcctcaggag

SEQ ID NO: 555636 - DNA, 22 bp, Homo sapiens
aagggttccctctgggccccaa

SEQ ID NO: 555637 - DNA, 22 bp, Homo sapiens
acccagtgttgtgggagaaatg

SEQ ID NO: 555638 - DNA, 22 bp, Homo sapiens
cgagacattcttaggaacaatg

SEQ ID NO: 555639 - DNA, 22 bp, Homo sapiens
tatagaattggaaatgcaagga

SEQ ID NO: 555640 - DNA, 22 bp, Homo sapiens
tggccagaggggtcctcagaca

SEQ ID NO: 555641 - DNA, 22 bp, Homo sapiens
caggtcacgggctctaccttgg

SEQ ID NO: 555642 - DNA, 22 bp, Homo sapiens
ttggcaatcagcatgtttagtc

SEQ ID NO: 555643 - DNA, 22 bp, Homo sapiens
cctccatggctccaagaaaaac

SEQ ID NO: 555644 - DNA, 22 bp, Homo sapiens
ttctgcccctgctgtctggtgg

SEQ ID NO: 555645 - DNA, 22 bp, Homo sapiens
aagtgattggaggtgggtgggg

SEQ ID NO: 555646 - DNA, 22 bp, Homo sapiens
ttttctttggtggcttcagagg

SEQ ID NO: 555647 - DNA, 22 bp, Homo sapiens
agggagggcaggctggcctcag

SEQ ID NO: 555648 - DNA, 22 bp, Homo sapiens
tgctatgtgccagcctgtgttc

SEQ ID NO: 555649 - DNA, 22 bp, Homo sapiens
aggaggcgaagacacagcctgg

SEQ ID NO: 555650 - DNA, 22 bp, Homo sapiens
tgtataccttttaaaacaagcc

SEQ ID NO: 555651 - DNA, 22 bp, Homo sapiens
ctggttcatatccatctttgtg

SEQ ID NO: 555652 - DNA, 22 bp, Homo sapiens
cagaaggccttgtatcccgtgc

SEQ ID NO: 555653 - DNA, 22 bp, Homo sapiens
ggggtcagtaggaacctagggt

SEQ ID NO: 555654 - DNA, 22 bp, Homo sapiens
tcctcacctgaactccatgttg

SEQ ID NO: 555655 - DNA, 22 bp, Homo sapiens
ttctctgtttcggccatgtgtg

SEQ ID NO: 555656 - DNA, 22 bp, Homo sapiens
tgggtgatgaggaagtgatgac

SEQ ID NO: 555657 - DNA, 22 bp, Homo sapiens
tctcaggaatgttgcagagtga

SEQ ID NO: 555658 - DNA, 22 bp, Homo sapiens
tcattcagccaacaaaatgttt

SEQ ID NO: 555659 - DNA, 22 bp, Homo sapiens
tgaggagacgcatttggataaa

SEQ ID NO: 555660 - DNA, 22 bp, Homo sapiens
aactgaattacttcttccatgg

SEQ ID NO: 555661 - DNA, 22 bp, Homo sapiens
aatgctgtcaaagtgatttgag

SEQ ID NO: 555662 - DNA, 22 bp, Homo sapiens
tccctgcacagaggctgtgcat

SEQ ID NO: 555663 - DNA, 22 bp, Homo sapiens
ggctctgggtctgtggggagcg

SEQ ID NO: 555664 - DNA, 22 bp, Homo sapiens
tggctgagatcaagaatgattc

SEQ ID NO: 555665 - DNA, 22 bp, Homo sapiens
agagagcgatcgcttgggaaaa

SEQ ID NO: 555666 - DNA, 22 bp, Homo sapiens
tgggttttaaagagttgattgt

SEQ ID NO: 555667 - DNA, 22 bp, Homo sapiens
aaggcatgggaagagaagtcta

SEQ ID NO: 555668 - DNA, 22 bp, Homo sapiens
ttttagctgtagttattatatt

SEQ ID NO: 555669 - DNA, 22 bp, Homo sapiens
tcattaactggttaataactat

SEQ ID NO: 555670 - DNA, 22 bp, Homo sapiens
tgaagcggagcaaaggtataag

SEQ ID NO: 555671 - DNA, 22 bp, Homo sapiens
ggagccaaggtggcagagtggt

SEQ ID NO: 555672 - DNA, 22 bp, Homo sapiens
tcatatgtgtcccaagtctcta

SEQ ID NO: 555673 - DNA, 22 bp, Homo sapiens
gccctgtgatgggatgtgggca

SEQ ID NO: 555674 - DNA, 22 bp, Homo sapiens
tccttcccttcccagtgagctc

SEQ ID NO: 555675 - DNA, 22 bp, Homo sapiens
acttccggccccgccgcggaag

SEQ ID NO: 555676 - DNA, 22 bp, Homo sapiens
ataacccaagatatgcataatc

SEQ ID NO: 555677 - DNA, 22 bp, Homo sapiens
tgtcttcctttgcagtctccat

SEQ ID NO: 555678 - DNA, 22 bp, Homo sapiens
gcatttgctggtggtggcaggg

SEQ ID NO: 555679 - DNA, 22 bp, Homo sapiens
agccttggtctcccgggccctc

SEQ ID NO: 555680 - DNA, 22 bp, Homo sapiens
tctttgtagaagctgaactctg

SEQ ID NO: 555681 - DNA, 22 bp, Homo sapiens
tgactgcctggatgtggcccct

SEQ ID NO: 555682 - DNA, 22 bp, Homo sapiens
caagggggtgaggagggtggtg

SEQ ID NO: 555683 - DNA, 22 bp, Homo sapiens
ggaccatcccagcctctcagtg

SEQ ID NO: 555684 - DNA, 22 bp, Homo sapiens
agaatgcttcctttgaaactga

SEQ ID NO: 555685 - DNA, 22 bp, Homo sapiens
tgacacttccggcatgatggat

SEQ ID NO: 555686 - DNA, 22 bp, Homo sapiens
gcctccgtgatggccgtggtgt

SEQ ID NO: 555687 - DNA, 22 bp, Homo sapiens
tagggcccggtcactgtggggt

SEQ ID NO: 555688 - DNA, 22 bp, Homo sapiens
tgaattctcatggcatctttga

SEQ ID NO: 555689 - DNA, 22 bp, Homo sapiens
aaaatgtatcttcgtgtcttta

SEQ ID NO: 555690 - DNA, 22 bp, Homo sapiens
atcccaggacagggcagacctg

SEQ ID NO: 555691 - DNA, 22 bp, Homo sapiens
tccttccctgtagcctaagtct

SEQ ID NO: 555692 - DNA, 22 bp, Homo sapiens
gggggatgtgggggtgagtttc

SEQ ID NO: 555693 - DNA, 22 bp, Homo sapiens
ctcctctgtttataacacaccc

SEQ ID NO: 555694 - DNA, 22 bp, Homo sapiens
tctgttccataggaaaggcact

SEQ ID NO: 555695 - DNA, 22 bp, Homo sapiens
gaggccctgtgcaaagcaggac

SEQ ID NO: 555696 - DNA, 22 bp, Homo sapiens
aatgctgagctgagcaatgagg

SEQ ID NO: 555697 - DNA, 22 bp, Homo sapiens
catgatcacagtaatgttcttt

SEQ ID NO: 555698 - DNA, 22 bp, Homo sapiens
ggctgtaatgcgatcccagaat

SEQ ID NO: 555699 - DNA, 22 bp, Homo sapiens
tccctgactctctttctgcgtg

SEQ ID NO: 555700 - DNA, 22 bp, Homo sapiens
caggtggaagaagggccgagtc

SEQ ID NO: 555701 - DNA, 22 bp, Homo sapiens
tcctgaatcatcccttctgtct

SEQ ID NO: 555702 - DNA, 22 bp, Homo sapiens
ttgtctctttcataccgttcac

SEQ ID NO: 555703 - DNA, 22 bp, Homo sapiens
attaagcccagccagttattaa

SEQ ID NO: 555704 - DNA, 22 bp, Homo sapiens
aatgtgacaatgggctattatt

SEQ ID NO: 555705 - DNA, 22 bp, Homo sapiens
gctggcactctcattgttacat

SEQ ID NO: 555706 - DNA, 22 bp, Homo sapiens
tggttttcagagtggattgaaa

SEQ ID NO: 555707 - DNA, 22 bp, Homo sapiens
taggcagtcagatatacatctc

SEQ ID NO: 555708 - DNA, 22 bp, Homo sapiens
tatttaggagtcattattggag

SEQ ID NO: 555709 - DNA, 22 bp, Homo sapiens
gtccagcattggttgccaggca

SEQ ID NO: 555710 - DNA, 22 bp, Homo sapiens
tgcattgctgttgcattgcacg

SEQ ID NO: 555711 - DNA, 22 bp, Homo sapiens
aggcctcagtgtcatggactct

SEQ ID NO: 555712 - DNA, 22 bp, Homo sapiens
tgtaccacagttatggaggctg

SEQ ID NO: 555713 - DNA, 22 bp, Homo sapiens
aagggcaggagggttggacatg

SEQ ID NO: 555714 - DNA, 22 bp, Homo sapiens
tgtgtgtttattgatatttcac

SEQ ID NO: 555715 - DNA, 22 bp, Homo sapiens
ctcttgagggaagcactttctg

SEQ ID NO: 555716 - DNA, 22 bp, Homo sapiens
taagacatgaagatttacagct

SEQ ID NO: 555717 - DNA, 22 bp, Homo sapiens
tgtggccatgtggggaaacagg

SEQ ID NO: 555718 - DNA, 22 bp, Homo sapiens
caggcaggggatggggaggaga

SEQ ID NO: 555719 - DNA, 22 bp, Homo sapiens
cacaggcggccctgacaggcgg

SEQ ID NO: 555720 - DNA, 22 bp, Homo sapiens
tgaaaagattgggaatgcagca

SEQ ID NO: 555721 - DNA, 22 bp, Homo sapiens
aatagtgcatgccagacatcat

SEQ ID NO: 555722 - DNA, 22 bp, Homo sapiens
tgccttcgctgctcagcctgtg

SEQ ID NO: 555723 - DNA, 22 bp, Homo sapiens
ctctgccttttgtccctgacag

SEQ ID NO: 555724 - DNA, 22 bp, Homo sapiens
tgtctggcagcttcgctcgggc

SEQ ID NO: 555725 - DNA, 22 bp, Homo sapiens
acctgctagatcctttttaggc

SEQ ID NO: 555726 - DNA, 22 bp, Homo sapiens
tgtcaggtgagtcctcatgctg

SEQ ID NO: 555727 - DNA, 22 bp, Homo sapiens
cagcagtggaaacaaggcctga

SEQ ID NO: 555728 - DNA, 22 bp, Homo sapiens
tggcaggtgaggggtggggggt

SEQ ID NO: 555729 - DNA, 22 bp, Homo sapiens
ccttctgcagtcaacacagccc

SEQ ID NO: 555730 - DNA, 22 bp, Homo sapiens
agagaaactgagcagcaccgca

SEQ ID NO: 555731 - DNA, 22 bp, Homo sapiens
gagcagaggctgggagatcgat

SEQ ID NO: 555732 - DNA, 22 bp, Homo sapiens
tgtgcttttacaattttttttt

SEQ ID NO: 555733 - DNA, 22 bp, Homo sapiens
ctctcagggtctggccgggtcc

SEQ ID NO: 555734 - DNA, 22 bp, Homo sapiens
tggtctattgggtaaatatgta

SEQ ID NO: 555735 - DNA, 22 bp, Homo sapiens
gtgcctcttgtcatccttcctt

SEQ ID NO: 555736 - DNA, 22 bp, Homo sapiens
ggtgtccatggcatccccattt

SEQ ID NO: 555737 - DNA, 22 bp, Homo sapiens
acctctacagtccttcagccta

SEQ ID NO: 555738 - DNA, 22 bp, Homo sapiens
cattgatggtagggaaggagtg

SEQ ID NO: 555739 - DNA, 22 bp, Homo sapiens
tgcaccagcttcggggtgcacc

SEQ ID NO: 555740 - DNA, 22 bp, Homo sapiens
tggcagtggtcccacttcttga

SEQ ID NO: 555741 - DNA, 22 bp, Homo sapiens
cagcccagcccgctgggaggtg

SEQ ID NO: 555742 - DNA, 22 bp, Homo sapiens
gtggagagtgcttcttctagtg

SEQ ID NO: 555743 - DNA, 22 bp, Homo sapiens
agagctaccttcacacagggcc

SEQ ID NO: 555744 - DNA, 22 bp, Homo sapiens
tgccccactgtgatttctaggt

SEQ ID NO: 555745 - DNA, 22 bp, Homo sapiens
taatttcctggagggagtcccg

SEQ ID NO: 555746 - DNA, 22 bp, Homo sapiens
cagggagcctgagtaactggaa

SEQ ID NO: 555747 - DNA, 22 bp, Homo sapiens
tatttgatgtaggctgagccac

SEQ ID NO: 555748 - DNA, 22 bp, Homo sapiens
gctggggtgggcagctgtgtct

SEQ ID NO: 555749 - DNA, 22 bp, Homo sapiens
tggcctctggcagatatcagtc

SEQ ID NO: 555750 - DNA, 22 bp, Homo sapiens
ttagtttagagcctgctatact

SEQ ID NO: 555751 - DNA, 22 bp, Homo sapiens
taagtagtaagccaggttaggc

SEQ ID NO: 555752 - DNA, 22 bp, Homo sapiens
tgttctgaggtccaccgacttt

SEQ ID NO: 555753 - DNA, 22 bp, Homo sapiens
catgggatttcctgccttcctt

SEQ ID NO: 555754 - DNA, 22 bp, Homo sapiens
tgctatttgcaaatatatttct

SEQ ID NO: 555755 - DNA, 22 bp, Homo sapiens
tcattacatggagaggaatttt

SEQ ID NO: 555756 - DNA, 22 bp, Homo sapiens
ccagtccaagatgaggatattt

SEQ ID NO: 555757 - DNA, 22 bp, Homo sapiens
tttcattcatttactcctcctt

SEQ ID NO: 555758 - DNA, 22 bp, Homo sapiens
ggtgggagacgctggagcagtg

SEQ ID NO: 555759 - DNA, 22 bp, Homo sapiens
tggtgtgaaagggacagagagg

SEQ ID NO: 555760 - DNA, 22 bp, Homo sapiens
taggcgaacacggtggcgagcc

SEQ ID NO: 555761 - DNA, 22 bp, Homo sapiens
attggttgcataatttgatctg

SEQ ID NO: 555762 - DNA, 22 bp, Homo sapiens
tctctcttgggtatctgagtgt

SEQ ID NO: 555763 - DNA, 22 bp, Homo sapiens
tactagtttctagcattctcac

SEQ ID NO: 555764 - DNA, 22 bp, Homo sapiens
tcagggcatgactatttgtagt

SEQ ID NO: 555765 - DNA, 22 bp, Homo sapiens
ttgaattttcagaagatgtggc

SEQ ID NO: 555766 - DNA, 22 bp, Homo sapiens
tttcttttacagtttcaggtct

SEQ ID NO: 555767 - DNA, 22 bp, Homo sapiens
ccgctcagctgctctctgacag

SEQ ID NO: 555768 - DNA, 22 bp, Homo sapiens
tctagctacccttggtacagca

SEQ ID NO: 555769 - DNA, 22 bp, Homo sapiens
tgtgctatgccactaagcatga

SEQ ID NO: 555770 - DNA, 22 bp, Homo sapiens
tgtcatcagcaagggtcagcca

SEQ ID NO: 555771 - DNA, 22 bp, Homo sapiens
gtgatttaaaatcattggagtg

SEQ ID NO: 555772 - DNA, 22 bp, Homo sapiens
ttaacgctcaaggatgcctctg

SEQ ID NO: 555773 - DNA, 22 bp, Homo sapiens
ccctccttggcctgccctttgt

SEQ ID NO: 555774 - DNA, 22 bp, Homo sapiens
ttcttctgtcagcatcttcttc

SEQ ID NO: 555775 - DNA, 22 bp, Homo sapiens
ttgggggtctgtgactttgggg

SEQ ID NO: 555776 - DNA, 22 bp, Homo sapiens
gggctctggggaggagcaggga

SEQ ID NO: 555777 - DNA, 22 bp, Homo sapiens
tgaatagctgggtggagttaat

SEQ ID NO: 555778 - DNA, 22 bp, Homo sapiens
tctgaccttcgcgtacctttaa

SEQ ID NO: 555779 - DNA, 22 bp, Homo sapiens
ggctcactggttttctcttatt

SEQ ID NO: 555780 - DNA, 22 bp, Homo sapiens
tcatccccactgattcaatctc

SEQ ID NO: 555781 - DNA, 22 bp, Homo sapiens
cacagcccgccctctttgaggt

SEQ ID NO: 555782 - DNA, 22 bp, Homo sapiens
catgtcacatatggtcatcgaa

SEQ ID NO: 555783 - DNA, 22 bp, Homo sapiens
gaatttgttctctttctgttaa

SEQ ID NO: 555784 - DNA, 22 bp, Homo sapiens
tttatagtttgtgcatttggat

SEQ ID NO: 555785 - DNA, 22 bp, Homo sapiens
attctcctttcctgagaacaat

SEQ ID NO: 555786 - DNA, 22 bp, Homo sapiens
ggtgtctgtattcagtttgtga

SEQ ID NO: 555787 - DNA, 22 bp, Homo sapiens
tcttgacagcttcattttcagg

SEQ ID NO: 555788 - DNA, 22 bp, Homo sapiens
ttaaatgagattagaagtcctg

SEQ ID NO: 555789 - DNA, 22 bp, Homo sapiens
ttatccagtaggaccagactgc

SEQ ID NO: 555790 - DNA, 22 bp, Homo sapiens
tttgtttgctctagctcctgct

SEQ ID NO: 555791 - DNA, 22 bp, Homo sapiens
tgcctttgatttgagtaaaaga

SEQ ID NO: 555792 - DNA, 22 bp, Homo sapiens
gctagcctgtctgctgtgtttt

SEQ ID NO: 555793 - DNA, 22 bp, Homo sapiens
tttaatgggattggcagattgc

SEQ ID NO: 555794 - DNA, 22 bp, Homo sapiens
tcattaatactttgcctagcta

SEQ ID NO: 555795 - DNA, 22 bp, Homo sapiens
cgctcttgggggagggatggac

SEQ ID NO: 555796 - DNA, 22 bp, Homo sapiens
tgggagaatttgaagttaaaat

SEQ ID NO: 555797 - DNA, 22 bp, Homo sapiens
taaatatgggcacagtgccaac

SEQ ID NO: 555798 - DNA, 22 bp, Homo sapiens
aggaagtgccagaaatgtcaga

SEQ ID NO: 555799 - DNA, 22 bp, Homo sapiens
ccagtgtgctgggctgtctgac

SEQ ID NO: 555800 - DNA, 22 bp, Homo sapiens
ttccccttctttctgccccacc

SEQ ID NO: 555801 - DNA, 22 bp, Homo sapiens
tattattaataccaatagccca

SEQ ID NO: 555802 - DNA, 22 bp, Homo sapiens
tccaacaaggaaagacaggagg

SEQ ID NO: 555803 - DNA, 22 bp, Homo sapiens
cctcagatatttggataattgc

SEQ ID NO: 555804 - DNA, 22 bp, Homo sapiens
aacagagtgactcactactgaa

SEQ ID NO: 555805 - DNA, 22 bp, Homo sapiens
tgtaaaaatcaatatttcagta

SEQ ID NO: 555806 - DNA, 22 bp, Homo sapiens
cccagctgtctgtgaacgctgg

SEQ ID NO: 555807 - DNA, 22 bp, Homo sapiens
tctggcagagcccagcatcttg

SEQ ID NO: 555808 - DNA, 22 bp, Homo sapiens
tccttgaggatgaggatggggc

SEQ ID NO: 555809 - DNA, 22 bp, Homo sapiens
gaaacagctgggacaggaaaac

SEQ ID NO: 555810 - DNA, 22 bp, Homo sapiens
aggcatgaagacttttggtgac

SEQ ID NO: 555811 - DNA, 22 bp, Homo sapiens
tgctgggtggcagattacacag

SEQ ID NO: 555812 - DNA, 22 bp, Homo sapiens
tttgacagcattttaattatag

SEQ ID NO: 555813 - DNA, 22 bp, Homo sapiens
ccaccagtgttgggcattgggg

SEQ ID NO: 555814 - DNA, 22 bp, Homo sapiens
tctgtgtgtgggagagggtggt

SEQ ID NO: 555815 - DNA, 22 bp, Homo sapiens
gctttttgtggcaggaaggtct

SEQ ID NO: 555816 - DNA, 22 bp, Homo sapiens
aaaggtgggcaaaatttctgtt

SEQ ID NO: 555817 - DNA, 22 bp, Homo sapiens
tcatgaaataattacactcctg

SEQ ID NO: 555818 - DNA, 22 bp, Homo sapiens
taaggcagatagagaattaaat

SEQ ID NO: 555819 - DNA, 22 bp, Homo sapiens
tgaggcatgctgggatttgtag

SEQ ID NO: 555820 - DNA, 22 bp, Homo sapiens
tgctcttcagcactgaatgaag

SEQ ID NO: 555821 - DNA, 22 bp, Homo sapiens
cagcatttggcatcaggaagga

SEQ ID NO: 555822 - DNA, 22 bp, Homo sapiens
gcttcctccagggaggggcctg

SEQ ID NO: 555823 - DNA, 22 bp, Homo sapiens
agtgtttttctacaagaagaga

SEQ ID NO: 555824 - DNA, 22 bp, Homo sapiens
tagctggtatcatatatgtgtc

SEQ ID NO: 555825 - DNA, 22 bp, Homo sapiens
taattatggaattatggcttaa

SEQ ID NO: 555826 - DNA, 22 bp, Homo sapiens
aagaacagagttgaatagaagg

SEQ ID NO: 555827 - DNA, 22 bp, Homo sapiens
ttattgcctggctttacagaat

SEQ ID NO: 555828 - DNA, 22 bp, Homo sapiens
tattttgagcctacaaaaagtt

SEQ ID NO: 555829 - DNA, 22 bp, Homo sapiens
tgtgcctgtaagatgtattagc

SEQ ID NO: 555830 - DNA, 22 bp, Homo sapiens
ttgcatgaattaaagatggggt

SEQ ID NO: 555831 - DNA, 22 bp, Homo sapiens
taaaatagattttatgggctga

SEQ ID NO: 555832 - DNA, 22 bp, Homo sapiens
ggtggggctgaaggaattcact

SEQ ID NO: 555833 - DNA, 22 bp, Homo sapiens
tcacacctatgaattcctggag

SEQ ID NO: 555834 - DNA, 22 bp, Homo sapiens
tctttctccatgccaagccctt

SEQ ID NO: 555835 - DNA, 22 bp, Homo sapiens
ggccggttcaagggcagtcaga

SEQ ID NO: 555836 - DNA, 22 bp, Homo sapiens
tcttagcatttctggtactgta

SEQ ID NO: 555837 - DNA, 22 bp, Homo sapiens
cacgacttcttgtcagcgtgat

SEQ ID NO: 555838 - DNA, 22 bp, Homo sapiens
atcgtcaccacgccccaagacc

SEQ ID NO: 555839 - DNA, 22 bp, Homo sapiens
agtctgtctgcacagcagtggc

SEQ ID NO: 555840 - DNA, 22 bp, Homo sapiens
taattccttttctttcttcctg

SEQ ID NO: 555841 - DNA, 22 bp, Homo sapiens
tacattcaatggaaaccagatg

SEQ ID NO: 555842 - DNA, 22 bp, Homo sapiens
tccccagagcctcctgagcccc

SEQ ID NO: 555843 - DNA, 22 bp, Homo sapiens
tcataaaggtggcgatggtatg

SEQ ID NO: 555844 - DNA, 22 bp, Homo sapiens
ttatatttcccttcagaagttg

SEQ ID NO: 555845 - DNA, 22 bp, Homo sapiens
tgggccgagccggggccgcctc

SEQ ID NO: 555846 - DNA, 22 bp, Homo sapiens
tggagatgggtttcacactcct

SEQ ID NO: 555847 - DNA, 22 bp, Homo sapiens
agacatcctgctgctgttgctc

SEQ ID NO: 555848 - DNA, 22 bp, Homo sapiens
ttcttaccctccttaccagcag

SEQ ID NO: 555849 - DNA, 22 bp, Homo sapiens
acttctccccttgaagaagcag

SEQ ID NO: 555850 - DNA, 22 bp, Homo sapiens
tagttaataagattggaagaaa

SEQ ID NO: 555851 - DNA, 22 bp, Homo sapiens
cgtgtattgtgtgtttatatag

SEQ ID NO: 555852 - DNA, 22 bp, Homo sapiens
gccatctgggcgtataagtgca

SEQ ID NO: 555853 - DNA, 22 bp, Homo sapiens
gcatagtgaggtggacagctag

SEQ ID NO: 555854 - DNA, 22 bp, Homo sapiens
aatggggagttgggtagggctg

SEQ ID NO: 555855 - DNA, 22 bp, Homo sapiens
cactggattatttggggtccac

SEQ ID NO: 555856 - DNA, 22 bp, Homo sapiens
ggggtacaattagcctctggcg

SEQ ID NO: 555857 - DNA, 22 bp, Homo sapiens
cagctgcatggtgaaatggcct

SEQ ID NO: 555858 - DNA, 22 bp, Homo sapiens
attcaagctctgacccacttac

SEQ ID NO: 555859 - DNA, 22 bp, Homo sapiens
tgcagagccctgaagccgacgg

SEQ ID NO: 555860 - DNA, 22 bp, Homo sapiens
tagaattgtggctacaatgagt

SEQ ID NO: 555861 - DNA, 22 bp, Homo sapiens
agaccctcaaaaggactctcct

SEQ ID NO: 555862 - DNA, 22 bp, Homo sapiens
cacagcaccgggcaccagggct

SEQ ID NO: 555863 - DNA, 22 bp, Homo sapiens
tctttcccagccctgcttgggt

SEQ ID NO: 555864 - DNA, 22 bp, Homo sapiens
ggtagggcacgggactaaggga

SEQ ID NO: 555865 - DNA, 22 bp, Homo sapiens
cattttgagtccttttaaatgt

SEQ ID NO: 555866 - DNA, 22 bp, Homo sapiens
tatgaaaatcggagattgggta

SEQ ID NO: 555867 - DNA, 22 bp, Homo sapiens
cttcagcaaggcagaagggagg

SEQ ID NO: 555868 - DNA, 22 bp, Homo sapiens
cagcctgttacctatatttggg

SEQ ID NO: 555869 - DNA, 22 bp, Homo sapiens
gcttgttttcaaaggtgtagga

SEQ ID NO: 555870 - DNA, 22 bp, Homo sapiens
gaggaaatgaggaatcattatg

SEQ ID NO: 555871 - DNA, 22 bp, Homo sapiens
ttggtttcttttgtgctttcta

SEQ ID NO: 555872 - DNA, 22 bp, Homo sapiens
tagtgaaattaaagaggaaaat

SEQ ID NO: 555873 - DNA, 22 bp, Homo sapiens
ggctgaggacccaagtcaggcc

SEQ ID NO: 555874 - DNA, 22 bp, Homo sapiens
catgtgggtcagttcattctca

SEQ ID NO: 555875 - DNA, 22 bp, Homo sapiens
caagaaggacacaaggatggct

SEQ ID NO: 555876 - DNA, 22 bp, Homo sapiens
taatacatataaaaaggcactt

SEQ ID NO: 555877 - DNA, 22 bp, Homo sapiens
tcctggagattctaaagtataa

SEQ ID NO: 555878 - DNA, 22 bp, Homo sapiens
tttttagtaacttgcagcaacc

SEQ ID NO: 555879 - DNA, 22 bp, Homo sapiens
aggtcagggtggccatgagtta

SEQ ID NO: 555880 - DNA, 22 bp, Homo sapiens
cccctgctgcccagtgtgtctg

SEQ ID NO: 555881 - DNA, 22 bp, Homo sapiens
acccaggtgtccacctagggcc

SEQ ID NO: 555882 - DNA, 22 bp, Homo sapiens
taagcatccatctcttcttcac

SEQ ID NO: 555883 - DNA, 22 bp, Homo sapiens
tggggcaggaggacattagctt

SEQ ID NO: 555884 - DNA, 22 bp, Homo sapiens
aatccttggaacctaggtgtga

SEQ ID NO: 555885 - DNA, 22 bp, Homo sapiens
tggactaggccagtggcaaaca

SEQ ID NO: 555886 - DNA, 22 bp, Homo sapiens
agcctaagcacaggttggtctt

SEQ ID NO: 555887 - DNA, 22 bp, Homo sapiens
aggctttcctttgtgttattgt

SEQ ID NO: 555888 - DNA, 22 bp, Homo sapiens
gccctcgcgcgctctgagcctc

SEQ ID NO: 555889 - DNA, 22 bp, Homo sapiens
tgtcagcataaggagttgagga

SEQ ID NO: 555890 - DNA, 22 bp, Homo sapiens
aggaacagtgggattgactgaa

SEQ ID NO: 555891 - DNA, 22 bp, Homo sapiens
ccatcctccatgcatgggaatc

SEQ ID NO: 555892 - DNA, 22 bp, Homo sapiens
aggggtgggatctgaatgtgtg

SEQ ID NO: 555893 - DNA, 22 bp, Homo sapiens
tcagcaaacattactatttaat

SEQ ID NO: 555894 - DNA, 22 bp, Homo sapiens
tcaggaaacattgctatttagt

SEQ ID NO: 555895 - DNA, 22 bp, Homo sapiens
gcgcagtggtgcgaggatgagc

SEQ ID NO: 555896 - DNA, 22 bp, Homo sapiens
agtggagagataagactggtaa

SEQ ID NO: 555897 - DNA, 22 bp, Homo sapiens
ggtggttcaggtcaccataggt

SEQ ID NO: 555898 - DNA, 22 bp, Homo sapiens
cagtccaagtggctcagtgtct

SEQ ID NO: 555899 - DNA, 22 bp, Homo sapiens
acccagatttccgcagacaacc

SEQ ID NO: 555900 - DNA, 22 bp, Homo sapiens
ttgataatgcaagtcaggctga

SEQ ID NO: 555901 - DNA, 22 bp, Homo sapiens
tgtgctaatttgcacattaata

SEQ ID NO: 555902 - DNA, 22 bp, Homo sapiens
gaggatgtgtcaccaggtggtg

SEQ ID NO: 555903 - DNA, 22 bp, Homo sapiens
gggggttatttttaattggggt

SEQ ID NO: 555904 - DNA, 22 bp, Homo sapiens
gtcactgcggctgtgggtgagg

SEQ ID NO: 555905 - DNA, 22 bp, Homo sapiens
tggaaattatgagggtaggagg

SEQ ID NO: 555906 - DNA, 22 bp, Homo sapiens
tcctcgggctcctggttgccct

SEQ ID NO: 555907 - DNA, 22 bp, Homo sapiens
ggacagtgagggaggaaggggg

SEQ ID NO: 555908 - DNA, 22 bp, Homo sapiens
gttgacagggattcagtgattc

SEQ ID NO: 555909 - DNA, 22 bp, Homo sapiens
tctcttccaggcccctgtggtt

SEQ ID NO: 555910 - DNA, 22 bp, Homo sapiens
agaagacatttcagaatttctt

SEQ ID NO: 555911 - DNA, 22 bp, Homo sapiens
tgcattccggcctcctctttct

SEQ ID NO: 555912 - DNA, 22 bp, Homo sapiens
tgttcccttgctccttcactct

SEQ ID NO: 555913 - DNA, 22 bp, Homo sapiens
tcatttggctccagaccttggc

SEQ ID NO: 555914 - DNA, 22 bp, Homo sapiens
tctcaaatacaccaggcatggc

SEQ ID NO: 555915 - DNA, 22 bp, Homo sapiens
tcctactgcttggatcaggggg

SEQ ID NO: 555916 - DNA, 22 bp, Homo sapiens
accctgaggatgaggaggagca

SEQ ID NO: 555917 - DNA, 22 bp, Homo sapiens
gggtggaccgcggtttctgctg

SEQ ID NO: 555918 - DNA, 22 bp, Homo sapiens
caggggtgagcgggagctgggg

SEQ ID NO: 555919 - DNA, 22 bp, Homo sapiens
tgttaacaggagagaatgatac

SEQ ID NO: 555920 - DNA, 22 bp, Homo sapiens
ttgacttactgtttgctggctg

SEQ ID NO: 555921 - DNA, 22 bp, Homo sapiens
gctttcagcatcaagtctgttc

SEQ ID NO: 555922 - DNA, 22 bp, Homo sapiens
tgctcacttaaccactcagata

SEQ ID NO: 555923 - DNA, 22 bp, Homo sapiens
tatgttcttgattttcaggttt

SEQ ID NO: 555924 - DNA, 22 bp, Homo sapiens
tgttctagccaaaaaagtttgc

SEQ ID NO: 555925 - DNA, 22 bp, Homo sapiens
ctaggagggttgggtggaggca

SEQ ID NO: 555926 - DNA, 22 bp, Homo sapiens
tgcactctgctgcagaccctcg

SEQ ID NO: 555927 - DNA, 22 bp, Homo sapiens
tgggttcactcattgctttttc

SEQ ID NO: 555928 - DNA, 22 bp, Homo sapiens
aataaatagctgttgagttgct

SEQ ID NO: 555929 - DNA, 22 bp, Homo sapiens
acctccatctccctccctctgc

SEQ ID NO: 555930 - DNA, 22 bp, Homo sapiens
gcagtgggggggaggtgatgtg

SEQ ID NO: 555931 - DNA, 22 bp, Homo sapiens
acaagggcagcacagtgaggac

SEQ ID NO: 555932 - DNA, 22 bp, Homo sapiens
cgtggctcagagtcatcggaca

SEQ ID NO: 555933 - DNA, 22 bp, Homo sapiens
taagacttagggatcggactta

SEQ ID NO: 555934 - DNA, 22 bp, Homo sapiens
tgctctcaggaaggagtatagt

SEQ ID NO: 555935 - DNA, 22 bp, Homo sapiens
tcatttgccaaggcctcctaac

SEQ ID NO: 555936 - DNA, 22 bp, Homo sapiens
aagactattggtggttcttgag

SEQ ID NO: 555937 - DNA, 22 bp, Homo sapiens
cccttgcttcttgggttcctgg

SEQ ID NO: 555938 - DNA, 22 bp, Homo sapiens
acgcagcagaaggtaatgcttt

SEQ ID NO: 555939 - DNA, 22 bp, Homo sapiens
tagaaagagctgtgtaggacaa

SEQ ID NO: 555940 - DNA, 22 bp, Homo sapiens
ttatgctggtagatgccctgct

SEQ ID NO: 555941 - DNA, 22 bp, Homo sapiens
tttgtcttataggaggaagaga

SEQ ID NO: 555942 - DNA, 22 bp, Homo sapiens
tgtcctggttttgtttcataca

SEQ ID NO: 555943 - DNA, 22 bp, Homo sapiens
tccatctgtcagtctgtttata

SEQ ID NO: 555944 - DNA, 22 bp, Homo sapiens
tgtttgtgaatgttgcggattg

SEQ ID NO: 555945 - DNA, 22 bp, Homo sapiens
agatctggtgagccggttgctg

SEQ ID NO: 555946 - DNA, 22 bp, Homo sapiens
ccctcggagagctcacagctgt

SEQ ID NO: 555947 - DNA, 22 bp, Homo sapiens
caaatctagagacagtttggag

SEQ ID NO: 555948 - DNA, 22 bp, Homo sapiens
cataataggaattttggcttct

SEQ ID NO: 555949 - DNA, 22 bp, Homo sapiens
agctatctgtaaattcccttca

SEQ ID NO: 555950 - DNA, 22 bp, Homo sapiens
attaaaaagagataggcttcaa

SEQ ID NO: 555951 - DNA, 22 bp, Homo sapiens
gctgtgaacttcaaatttggca

SEQ ID NO: 555952 - DNA, 22 bp, Homo sapiens
ttaaattgtccagttgagataa

SEQ ID NO: 555953 - DNA, 22 bp, Homo sapiens
atcctgttttgccagtgagaag

SEQ ID NO: 555954 - DNA, 22 bp, Homo sapiens
tgacagttttatagagtgcttc

SEQ ID NO: 555955 - DNA, 22 bp, Homo sapiens
cagatctgtgattatgtcaggg

SEQ ID NO: 555956 - DNA, 22 bp, Homo sapiens
atcagtttattaacgctatgtt

SEQ ID NO: 555957 - DNA, 22 bp, Homo sapiens
tgtggaattagtctttgtccca

SEQ ID NO: 555958 - DNA, 22 bp, Homo sapiens
tgctagattcagcaggaagggg

SEQ ID NO: 555959 - DNA, 22 bp, Homo sapiens
gaacttcttctttaagagactc

SEQ ID NO: 555960 - DNA, 22 bp, Homo sapiens
ggtccgagcctgggtctccctc

SEQ ID NO: 555961 - DNA, 22 bp, Homo sapiens
cctcagctgtgttcttggtatc

SEQ ID NO: 555962 - DNA, 22 bp, Homo sapiens
agcagcaggcgcacggccgtct

SEQ ID NO: 555963 - DNA, 22 bp, Homo sapiens
gaggagctgcctggcagagggg

SEQ ID NO: 555964 - DNA, 22 bp, Homo sapiens
agggtcttgctctgggttttaa

SEQ ID NO: 555965 - DNA, 22 bp, Homo sapiens
cgcactggtccaggcaagcata

SEQ ID NO: 555966 - DNA, 22 bp, Homo sapiens
tgggagagatggaaagcaagat

SEQ ID NO: 555967 - DNA, 22 bp, Homo sapiens
tagaggatggctctggtcttct

SEQ ID NO: 555968 - DNA, 22 bp, Homo sapiens
tccctggcttcctggagctcac

SEQ ID NO: 555969 - DNA, 22 bp, Homo sapiens
tggtgtaattaaagtgatttct

SEQ ID NO: 555970 - DNA, 22 bp, Homo sapiens
tggggtaggatgtgttctcgtt

SEQ ID NO: 555971 - DNA, 22 bp, Homo sapiens
tgagtggctggtgaggttagcc

SEQ ID NO: 555972 - DNA, 22 bp, Homo sapiens
tgtgggggcaggaggggcgtca

SEQ ID NO: 555973 - DNA, 22 bp, Homo sapiens
ggataaatagagccctcacatc

SEQ ID NO: 555974 - DNA, 22 bp, Homo sapiens
tgagttatgggaaaagtttagg

SEQ ID NO: 555975 - DNA, 22 bp, Homo sapiens
tattcctccttcatacttgcag

SEQ ID NO: 555976 - DNA, 22 bp, Homo sapiens
tcctcatgccctctccctgctc

SEQ ID NO: 555977 - DNA, 22 bp, Homo sapiens
tgtttttttcaggggggttgga

SEQ ID NO: 555978 - DNA, 22 bp, Homo sapiens
tctaggttttttttttttttgg

SEQ ID NO: 555979 - DNA, 22 bp, Homo sapiens
ggcccacctctgtgtggtcacc

SEQ ID NO: 555980 - DNA, 22 bp, Homo sapiens
cacctgacattgtcatctgaga

SEQ ID NO: 555981 - DNA, 22 bp, Homo sapiens
tgtccagtcatggggtgcaggt

SEQ ID NO: 555982 - DNA, 22 bp, Homo sapiens
accagcatgactctagcatgct

SEQ ID NO: 555983 - DNA, 22 bp, Homo sapiens
tggaaccatgtccttgctttga

SEQ ID NO: 555984 - DNA, 22 bp, Homo sapiens
cagccctgggggaggcctcggc

SEQ ID NO: 555985 - DNA, 22 bp, Homo sapiens
gtaggactcagatgaggggatg

SEQ ID NO: 555986 - DNA, 22 bp, Homo sapiens
tacccctcccctcgcgcgctcg

SEQ ID NO: 555987 - DNA, 22 bp, Homo sapiens
aagatcacctaggaagtgggtc

SEQ ID NO: 555988 - DNA, 22 bp, Homo sapiens
aaggcgatggggaaatgtaggc

SEQ ID NO: 555989 - DNA, 22 bp, Homo sapiens
ttgctccctcccctttgggttc

SEQ ID NO: 555990 - DNA, 22 bp, Homo sapiens
cttccgtttccctcactattcc

SEQ ID NO: 555991 - DNA, 22 bp, Homo sapiens
cggtgacactcagggcccggcc

SEQ ID NO: 555992 - DNA, 22 bp, Homo sapiens
aggttatgaccagctgaggcct

SEQ ID NO: 555993 - DNA, 22 bp, Homo sapiens
agggaagcacaatcctagtatc

SEQ ID NO: 555994 - DNA, 22 bp, Homo sapiens
ggaagtgtttctttggcatata

SEQ ID NO: 555995 - DNA, 22 bp, Homo sapiens
ccgcgtgcctcaaggggaggct

SEQ ID NO: 555996 - DNA, 22 bp, Homo sapiens
taggttcagttatcctatcctc

SEQ ID NO: 555997 - DNA, 22 bp, Homo sapiens
agtaggcattgaagaccagcag

SEQ ID NO: 555998 - DNA, 22 bp, Homo sapiens
tgagcagtgaaggagaaaagga

SEQ ID NO: 555999 - DNA, 22 bp, Homo sapiens
taattatccaggtaatttaggg

SEQ ID NO: 556000 - DNA, 22 bp, Homo sapiens
tgcccaactccagaggaccctg

SEQ ID NO: 556001 - DNA, 22 bp, Homo sapiens
gccatcgttgggtttaattact

SEQ ID NO: 556002 - DNA, 22 bp, Homo sapiens
ttgctgcttgctctaaatccat

SEQ ID NO: 556003 - DNA, 22 bp, Homo sapiens
tccccacactagtccgggtccc

SEQ ID NO: 556004 - DNA, 22 bp, Homo sapiens
tgtggcttccccagcccgtctt

SEQ ID NO: 556005 - DNA, 22 bp, Homo sapiens
agtgcagtggagggatagaagc

SEQ ID NO: 556006 - DNA, 22 bp, Homo sapiens
taggaagcccgggtgctgaggt

SEQ ID NO: 556007 - DNA, 22 bp, Homo sapiens
attcattgattgaaaagagcag

SEQ ID NO: 556008 - DNA, 22 bp, Homo sapiens
tggctgatgacagaacaatgtg

SEQ ID NO: 556009 - DNA, 22 bp, Homo sapiens
caaagctttgagtcagcatctt

SEQ ID NO: 556010 - DNA, 22 bp, Homo sapiens
gcttgggacgagctggaggaag

SEQ ID NO: 556011 - DNA, 22 bp, Homo sapiens
gagatatagcagtgaggacaat

SEQ ID NO: 556012 - DNA, 22 bp, Homo sapiens
ttttcaggagatgtggttatac

SEQ ID NO: 556013 - DNA, 22 bp, Homo sapiens
gcactgctgggattgtgtcttt

SEQ ID NO: 556014 - DNA, 22 bp, Homo sapiens
cagagctctttaaatattgctg

SEQ ID NO: 556015 - DNA, 22 bp, Homo sapiens
taaggggcctctttctcattct

SEQ ID NO: 556016 - DNA, 22 bp, Homo sapiens
aagtgaatcctcctgatttcag

SEQ ID NO: 556017 - DNA, 22 bp, Homo sapiens
gggatgccccgagggctcctgc

SEQ ID NO: 556018 - DNA, 22 bp, Homo sapiens
gaccatgatctggtctgggatg

SEQ ID NO: 556019 - DNA, 22 bp, Homo sapiens
ttggccactggggtgttgagtt

SEQ ID NO: 556020 - DNA, 22 bp, Homo sapiens
gatgagctcaggtacttagaga

SEQ ID NO: 556021 - DNA, 22 bp, Homo sapiens
tgttatgttcacttcagggttg

SEQ ID NO: 556022 - DNA, 22 bp, Homo sapiens
agctatgtatctaaactatttc

SEQ ID NO: 556023 - DNA, 22 bp, Homo sapiens
gggcttcactcactgcttaaat

SEQ ID NO: 556024 - DNA, 22 bp, Homo sapiens
ttttgctgcccaggcctcttgg

SEQ ID NO: 556025 - DNA, 22 bp, Homo sapiens
cctcatctggggctttaatgga

SEQ ID NO: 556026 - DNA, 22 bp, Homo sapiens
tgcctctcatttcctgccagtc

SEQ ID NO: 556027 - DNA, 22 bp, Homo sapiens
tttgccacaggcaaagtttgct

SEQ ID NO: 556028 - DNA, 22 bp, Homo sapiens
cctgtagagattgagggcaagt

SEQ ID NO: 556029 - DNA, 22 bp, Homo sapiens
cactgaaatcttgactgtacac

SEQ ID NO: 556030 - DNA, 22 bp, Homo sapiens
ctgcctgggttctgtgtctgag

SEQ ID NO: 556031 - DNA, 22 bp, Homo sapiens
gactggggtggggagcgaggag

SEQ ID NO: 556032 - DNA, 22 bp, Homo sapiens
agatcagggactctgtctttat

SEQ ID NO: 556033 - DNA, 22 bp, Homo sapiens
ttggcaatcgtctccattttta

SEQ ID NO: 556034 - DNA, 22 bp, Homo sapiens
cccctcgcgacgatgtagcaac

SEQ ID NO: 556035 - DNA, 22 bp, Homo sapiens
tgataaatattttggctgactg

SEQ ID NO: 556036 - DNA, 22 bp, Homo sapiens
agaagacgttttgggttgtgaa

SEQ ID NO: 556037 - DNA, 22 bp, Homo sapiens
gtaagctgtgaaatgttggctg

SEQ ID NO: 556038 - DNA, 22 bp, Homo sapiens
tccttcccctctgcctccgggc

SEQ ID NO: 556039 - DNA, 22 bp, Homo sapiens
ttcagagactggttatcattca

SEQ ID NO: 556040 - DNA, 22 bp, Homo sapiens
ttcacagggaggtgtcatttat

SEQ ID NO: 556041 - DNA, 22 bp, Homo sapiens
tctccactactgcggccacaca

SEQ ID NO: 556042 - DNA, 22 bp, Homo sapiens
tctgcacatgttcatcatgaca

SEQ ID NO: 556043 - DNA, 22 bp, Homo sapiens
tcttacacctaggtaaagcctt

SEQ ID NO: 556044 - DNA, 22 bp, Homo sapiens
acagtggatcgggatgcactgg

SEQ ID NO: 556045 - DNA, 22 bp, Homo sapiens
tttgagctgacagctatttaag

SEQ ID NO: 556046 - DNA, 22 bp, Homo sapiens
tgctcacctgcctattttaggt

SEQ ID NO: 556047 - DNA, 22 bp, Homo sapiens
ttacccctgactcttgctgtgc

SEQ ID NO: 556048 - DNA, 22 bp, Homo sapiens
tggacaggactggggccaggac

SEQ ID NO: 556049 - DNA, 22 bp, Homo sapiens
cagactcctcatccagtgctcc

SEQ ID NO: 556050 - DNA, 22 bp, Homo sapiens
tagtttttatatagaaatcaac

SEQ ID NO: 556051 - DNA, 22 bp, Homo sapiens
tgactttcccagctgaaataat

SEQ ID NO: 556052 - DNA, 22 bp, Homo sapiens
tgaaactctctgtggtatttgt

SEQ ID NO: 556053 - DNA, 22 bp, Homo sapiens
tctctatcccagagctccagaa

SEQ ID NO: 556054 - DNA, 22 bp, Homo sapiens
atatgcaattacttgcttgcat

SEQ ID NO: 556055 - DNA, 22 bp, Homo sapiens
cgagcctttaggggtatgagag

SEQ ID NO: 556056 - DNA, 22 bp, Homo sapiens
tttttcccccgcttcctcctat

SEQ ID NO: 556057 - DNA, 22 bp, Homo sapiens
cccttctgctgcatctcctgct

SEQ ID NO: 556058 - DNA, 22 bp, Homo sapiens
ggttttctggaaaataggccct

SEQ ID NO: 556059 - DNA, 22 bp, Homo sapiens
atgagggtgaggaagagagggg

SEQ ID NO: 556060 - DNA, 22 bp, Homo sapiens
cctcattaaatgtttgttgaat

SEQ ID NO: 556061 - DNA, 22 bp, Homo sapiens
tggcatctgtcctcatgtgaga

SEQ ID NO: 556062 - DNA, 22 bp, Homo sapiens
ccctggagccggctggggcgga

SEQ ID NO: 556063 - DNA, 22 bp, Homo sapiens
cgggacctaggtccagcaaggc

SEQ ID NO: 556064 - DNA, 22 bp, Homo sapiens
tgcttcccctctgaggtgcgga

SEQ ID NO: 556065 - DNA, 22 bp, Homo sapiens
tcctgtatgcaggccttgagcg

SEQ ID NO: 556066 - DNA, 22 bp, Homo sapiens
tggaggacaggggaggccattg

SEQ ID NO: 556067 - DNA, 22 bp, Homo sapiens
taaccctcaaagaatccacata

SEQ ID NO: 556068 - DNA, 22 bp, Homo sapiens
aactagactgtaagttccatga

SEQ ID NO: 556069 - DNA, 22 bp, Homo sapiens
cacataaaaggtagcagtttga

SEQ ID NO: 556070 - DNA, 22 bp, Homo sapiens
acgatggacatgcagtacaaca

SEQ ID NO: 556071 - DNA, 22 bp, Homo sapiens
gaagccatgaatcaggagaggt

SEQ ID NO: 556072 - DNA, 22 bp, Homo sapiens
tggatgccttttatttctttgt

SEQ ID NO: 556073 - DNA, 22 bp, Homo sapiens
gatggaagaggccatatgtggc

SEQ ID NO: 556074 - DNA, 22 bp, Homo sapiens
tatagtaggattatatagtagt

SEQ ID NO: 556075 - DNA, 22 bp, Homo sapiens
tgcggcagggggatcatttgca

SEQ ID NO: 556076 - DNA, 22 bp, Homo sapiens
gactgcgagctccttgaaggct

SEQ ID NO: 556077 - DNA, 22 bp, Homo sapiens
tattactatgaaggctggaggg

SEQ ID NO: 556078 - DNA, 22 bp, Homo sapiens
ccagtcttccactgtcccgcct

SEQ ID NO: 556079 - DNA, 22 bp, Homo sapiens
tgtgctttgctgtggggcagtg

SEQ ID NO: 556080 - DNA, 22 bp, Homo sapiens
tgcagcccgggaaactgaggca

SEQ ID NO: 556081 - DNA, 22 bp, Homo sapiens
tttataatccatctggggtctc

SEQ ID NO: 556082 - DNA, 22 bp, Homo sapiens
tcctttcttgtttacttctttt

SEQ ID NO: 556083 - DNA, 22 bp, Homo sapiens
gacttgaccttaagcacacttg

SEQ ID NO: 556084 - DNA, 22 bp, Homo sapiens
ggaaaggaatttctgaccatga

SEQ ID NO: 556085 - DNA, 22 bp, Homo sapiens
tttgcagaatgcttttgttcag

SEQ ID NO: 556086 - DNA, 22 bp, Homo sapiens
tacaggtcccagcatgcagtgc

SEQ ID NO: 556087 - DNA, 22 bp, Homo sapiens
aggacacgggcctgagggctga

SEQ ID NO: 556088 - DNA, 22 bp, Homo sapiens
tggtagaaggagggaagaggct

SEQ ID NO: 556089 - DNA, 22 bp, Homo sapiens
tatctggagaaaagtgtgcttt

SEQ ID NO: 556090 - DNA, 22 bp, Homo sapiens
ccataatgagcttaggttttta

SEQ ID NO: 556091 - DNA, 22 bp, Homo sapiens
actgacgaccacaagttggatg

SEQ ID NO: 556092 - DNA, 22 bp, Homo sapiens
gctggagaggaaagcatggttc

SEQ ID NO: 556093 - DNA, 22 bp, Homo sapiens
agctctgactgtgtgcctggta

SEQ ID NO: 556094 - DNA, 22 bp, Homo sapiens
ttttatgcctgtgacagcttca

SEQ ID NO: 556095 - DNA, 22 bp, Homo sapiens
ggttctgaaatgtcttcaagtc

SEQ ID NO: 556096 - DNA, 22 bp, Homo sapiens
gacaagcaacattagcagtagt

SEQ ID NO: 556097 - DNA, 22 bp, Homo sapiens
attggttgcgtaatttgatttt

SEQ ID NO: 556098 - DNA, 22 bp, Homo sapiens
tgcagaagtcccaggactggca

SEQ ID NO: 556099 - DNA, 22 bp, Homo sapiens
gccatgagcagaacagactgga

SEQ ID NO: 556100 - DNA, 22 bp, Homo sapiens
tagctcgccatgtgtctccctg

SEQ ID NO: 556101 - DNA, 22 bp, Homo sapiens
agtttacagtcgtgggtgccat

SEQ ID NO: 556102 - DNA, 22 bp, Homo sapiens
agcattcagcatataatcctac

SEQ ID NO: 556103 - DNA, 22 bp, Homo sapiens
tggtcaaaaactctcagtggac

SEQ ID NO: 556104 - DNA, 22 bp, Homo sapiens
taatggctttctgcggtcatta

SEQ ID NO: 556105 - DNA, 22 bp, Homo sapiens
tcagcagttgggagttattttt

SEQ ID NO: 556106 - DNA, 22 bp, Homo sapiens
ggtgggtggaggtgtctccagg

SEQ ID NO: 556107 - DNA, 22 bp, Homo sapiens
atctgggagccctggagggctg

SEQ ID NO: 556108 - DNA, 22 bp, Homo sapiens
aaacacaagagcaaggtgctga

SEQ ID NO: 556109 - DNA, 22 bp, Homo sapiens
tctgattcagtgatcctcttct

SEQ ID NO: 556110 - DNA, 22 bp, Homo sapiens
tcccctcctcccctgctgccgc

SEQ ID NO: 556111 - DNA, 22 bp, Homo sapiens
ttgcaagtcagtagagaggtac

SEQ ID NO: 556112 - DNA, 22 bp, Homo sapiens
tcctgagccatgatgggcccca

SEQ ID NO: 556113 - DNA, 22 bp, Homo sapiens
ttctgtcctcccatgccagagg

SEQ ID NO: 556114 - DNA, 22 bp, Homo sapiens
gttacttagttcagagcctgta

SEQ ID NO: 556115 - DNA, 22 bp, Homo sapiens
aagtcaaaggcatgctgaggaa

SEQ ID NO: 556116 - DNA, 22 bp, Homo sapiens
cgagtcctgctgacttcctgcc

SEQ ID NO: 556117 - DNA, 22 bp, Homo sapiens
tgcttgatttcccctcgtctgt

SEQ ID NO: 556118 - DNA, 22 bp, Homo sapiens
ttgcatattatatgtgccttat

SEQ ID NO: 556119 - DNA, 22 bp, Homo sapiens
tgcctttaaaggactcattgac

SEQ ID NO: 556120 - DNA, 22 bp, Homo sapiens
ggtccggggctcatatcctggg

SEQ ID NO: 556121 - DNA, 22 bp, Homo sapiens
attaaaagctgctttgaatcca

SEQ ID NO: 556122 - DNA, 22 bp, Homo sapiens
taatggtccagggtcacttttt

SEQ ID NO: 556123 - DNA, 22 bp, Homo sapiens
aaatgtctattgagcacccact

SEQ ID NO: 556124 - DNA, 22 bp, Homo sapiens
acagtcctgtggagtgggcatg

SEQ ID NO: 556125 - DNA, 22 bp, Homo sapiens
tttgtggtgaatggcttccggc

SEQ ID NO: 556126 - DNA, 22 bp, Homo sapiens
actcagtctggggtgcagaatt

SEQ ID NO: 556127 - DNA, 22 bp, Homo sapiens
agagtgtttgctgtataattgg

SEQ ID NO: 556128 - DNA, 22 bp, Homo sapiens
tttggctggccctagcatgtgt

SEQ ID NO: 556129 - DNA, 22 bp, Homo sapiens
tcacacaagataggcttttggg

SEQ ID NO: 556130 - DNA, 22 bp, Homo sapiens
tttggtaataggtatagtacct

SEQ ID NO: 556131 - DNA, 22 bp, Homo sapiens
ttcctcatcgagcccagggctg

SEQ ID NO: 556132 - DNA, 22 bp, Homo sapiens
tggcatacagtaggtgctcagt

SEQ ID NO: 556133 - DNA, 22 bp, Homo sapiens
cctcacgtccttcctgataggc

SEQ ID NO: 556134 - DNA, 22 bp, Homo sapiens
tgccaaatttgaaataccatct

SEQ ID NO: 556135 - DNA, 22 bp, Homo sapiens
aggcctccaggtgctgccacca

SEQ ID NO: 556136 - DNA, 22 bp, Homo sapiens
tttgaataaacatccggtcact

SEQ ID NO: 556137 - DNA, 22 bp, Homo sapiens
gtggtaggggtgaggaaggagg

SEQ ID NO: 556138 - DNA, 22 bp, Homo sapiens
tgaatggggcaccaatgtacac

SEQ ID NO: 556139 - DNA, 22 bp, Homo sapiens
ggtgagatataaataagccaat

SEQ ID NO: 556140 - DNA, 22 bp, Homo sapiens
ttgattgttgacattggtggca

SEQ ID NO: 556141 - DNA, 22 bp, Homo sapiens
tctgttgtgtggcctcatgtgc

SEQ ID NO: 556142 - DNA, 22 bp, Homo sapiens
aagcacagctggacaggttgtt

SEQ ID NO: 556143 - DNA, 22 bp, Homo sapiens
tgttgcttctggcatgttatga

SEQ ID NO: 556144 - DNA, 22 bp, Homo sapiens
tgaggagccagggaagcaggtg

SEQ ID NO: 556145 - DNA, 22 bp, Homo sapiens
tttccacaggatggtggggggg

SEQ ID NO: 556146 - DNA, 22 bp, Homo sapiens
gtttggggctgagcctggtgcc

SEQ ID NO: 556147 - DNA, 22 bp, Homo sapiens
ttgtgtgtgggtagggggcaac

SEQ ID NO: 556148 - DNA, 22 bp, Homo sapiens
tggcttcctattgccttgagaa

SEQ ID NO: 556149 - DNA, 22 bp, Homo sapiens
attttgccagttgttcagagaa

SEQ ID NO: 556150 - DNA, 22 bp, Homo sapiens
gaagctttttgctcgaattatg

SEQ ID NO: 556151 - DNA, 22 bp, Homo sapiens
tgacagggcaggcctgtgcttg

SEQ ID NO: 556152 - DNA, 22 bp, Homo sapiens
tggtttgtcaccagaaccccca

SEQ ID NO: 556153 - DNA, 22 bp, Homo sapiens
tttgaagaagggagagagatct

SEQ ID NO: 556154 - DNA, 22 bp, Homo sapiens
tcctcccctctgtagccctttc

SEQ ID NO: 556155 - DNA, 22 bp, Homo sapiens
caggggagggggaggaggcagt

SEQ ID NO: 556156 - DNA, 22 bp, Homo sapiens
tgtctacctggacggccacagg

SEQ ID NO: 556157 - DNA, 22 bp, Homo sapiens
aggcctcttgtcctttccttgg

SEQ ID NO: 556158 - DNA, 22 bp, Homo sapiens
tgacccattttaagcagttccc

SEQ ID NO: 556159 - DNA, 22 bp, Homo sapiens
aagggaactctttcacttttgc

SEQ ID NO: 556160 - DNA, 22 bp, Homo sapiens
tttcccttccagcagctcccac

SEQ ID NO: 556161 - DNA, 22 bp, Homo sapiens
tcagatcaatatcaatcaggag

SEQ ID NO: 556162 - DNA, 22 bp, Homo sapiens
acatctcctgaaaacgcagatg

SEQ ID NO: 556163 - DNA, 22 bp, Homo sapiens
tttggtggttggtattctgtta

SEQ ID NO: 556164 - DNA, 22 bp, Homo sapiens
aaaaaacattggctcataccag

SEQ ID NO: 556165 - DNA, 22 bp, Homo sapiens
tcttgacctcctgggacagttc

SEQ ID NO: 556166 - DNA, 22 bp, Homo sapiens
gatggtgacatctatttccgct

SEQ ID NO: 556167 - DNA, 22 bp, Homo sapiens
ggctatagcaaaacttgattta

SEQ ID NO: 556168 - DNA, 22 bp, Homo sapiens
tatactgccatggtgactctag

SEQ ID NO: 556169 - DNA, 22 bp, Homo sapiens
tgcctttcctttcttgttgcca

SEQ ID NO: 556170 - DNA, 22 bp, Homo sapiens
taggttacatgcaagcaagcca

SEQ ID NO: 556171 - DNA, 22 bp, Homo sapiens
ttgaaacaaactccagtgaact

SEQ ID NO: 556172 - DNA, 22 bp, Homo sapiens
agtgtgattcagtataatataa

SEQ ID NO: 556173 - DNA, 22 bp, Homo sapiens
actgggtgctgcgtttctgtgc

SEQ ID NO: 556174 - DNA, 22 bp, Homo sapiens
gttaatgaattattatagtgca

SEQ ID NO: 556175 - DNA, 22 bp, Homo sapiens
cacatctgggaggtggtatgag

SEQ ID NO: 556176 - DNA, 22 bp, Homo sapiens
tgcagagctaggctgagtgaat

SEQ ID NO: 556177 - DNA, 22 bp, Homo sapiens
tgtttagaaactagaaatgtag

SEQ ID NO: 556178 - DNA, 22 bp, Homo sapiens
cagtgacctgaagaagatggga

SEQ ID NO: 556179 - DNA, 22 bp, Homo sapiens
tctacccccttttctggtgacc

SEQ ID NO: 556180 - DNA, 22 bp, Homo sapiens
tttgaggccactagggaaccag

SEQ ID NO: 556181 - DNA, 22 bp, Homo sapiens
ggagctggggcagctgtgggaa

SEQ ID NO: 556182 - DNA, 22 bp, Homo sapiens
taagcctatctatccaaatatg

SEQ ID NO: 556183 - DNA, 22 bp, Homo sapiens
ggcctgtttgcagaaggtgggt

SEQ ID NO: 556184 - DNA, 22 bp, Homo sapiens
tcaagttaaatggggtctttct

SEQ ID NO: 556185 - DNA, 22 bp, Homo sapiens
tccttatttctcttcttctgat

SEQ ID NO: 556186 - DNA, 22 bp, Homo sapiens
gagaagatcagaggtgaagggt

SEQ ID NO: 556187 - DNA, 22 bp, Homo sapiens
taatgtgtcaggagtaaacagc

SEQ ID NO: 556188 - DNA, 22 bp, Homo sapiens
tggatttagtcggcttttagtg

SEQ ID NO: 556189 - DNA, 22 bp, Homo sapiens
aggaaactgaagtccagaaagg

SEQ ID NO: 556190 - DNA, 22 bp, Homo sapiens
tggagcccaggaagacagagac

SEQ ID NO: 556191 - DNA, 22 bp, Homo sapiens
gagcttgtcatttctttgcact

SEQ ID NO: 556192 - DNA, 22 bp, Homo sapiens
tgggtgtggctgcccattggtc

SEQ ID NO: 556193 - DNA, 22 bp, Homo sapiens
agcacagctgaggttctgggac

SEQ ID NO: 556194 - DNA, 22 bp, Homo sapiens
agttctttttcacagatgagat

SEQ ID NO: 556195 - DNA, 22 bp, Homo sapiens
tctgagctcagggcctggcccc

SEQ ID NO: 556196 - DNA, 22 bp, Homo sapiens
tgggcactgcctgtggcaccca

SEQ ID NO: 556197 - DNA, 22 bp, Homo sapiens
taaactgtaccttaggggcctg

SEQ ID NO: 556198 - DNA, 22 bp, Homo sapiens
gtttgaaatggtggggagaggg

SEQ ID NO: 556199 - DNA, 22 bp, Homo sapiens
tagcttcttgcttggctgagca

SEQ ID NO: 556200 - DNA, 22 bp, Homo sapiens
cagaacgggagcttgttactgg

SEQ ID NO: 556201 - DNA, 22 bp, Homo sapiens
ccccctgccgcctcttgtcccc

SEQ ID NO: 556202 - DNA, 22 bp, Homo sapiens
ttacccaaagtcagcaaccctt

SEQ ID NO: 556203 - DNA, 22 bp, Homo sapiens
ttcattcaggtgtatttatggg

SEQ ID NO: 556204 - DNA, 22 bp, Homo sapiens
cgttcagtcagagaaaaatttg

SEQ ID NO: 556205 - DNA, 22 bp, Homo sapiens
gcctctgattttagatcaagag

SEQ ID NO: 556206 - DNA, 22 bp, Homo sapiens
gattcctgctttctccactcac

SEQ ID NO: 556207 - DNA, 22 bp, Homo sapiens
atgactaatggaaaatacaatg

SEQ ID NO: 556208 - DNA, 22 bp, Homo sapiens
tacttacatacttaataggctg

SEQ ID NO: 556209 - DNA, 22 bp, Homo sapiens
tggaggcctgggggcagagggg

SEQ ID NO: 556210 - DNA, 22 bp, Homo sapiens
tgaactatcacctaatcctgga

SEQ ID NO: 556211 - DNA, 22 bp, Homo sapiens
ctggtgctgtcctgggggttgc

SEQ ID NO: 556212 - DNA, 22 bp, Homo sapiens
ttctgattgacacaggatggac

SEQ ID NO: 556213 - DNA, 22 bp, Homo sapiens
ttggcagtccagggtcaaacag

SEQ ID NO: 556214 - DNA, 22 bp, Homo sapiens
taggactgtgcttggcacatag

SEQ ID NO: 556215 - DNA, 22 bp, Homo sapiens
ggagtcatgcttctctgaggtt

SEQ ID NO: 556216 - DNA, 22 bp, Homo sapiens
ctgggaaggtgtggcatgtcca

SEQ ID NO: 556217 - DNA, 22 bp, Homo sapiens
ttacttttcatttattactttt

SEQ ID NO: 556218 - DNA, 22 bp, Homo sapiens
tatagttttgtggtcattactg

SEQ ID NO: 556219 - DNA, 22 bp, Homo sapiens
gctttgtaccaggctttctggt

SEQ ID NO: 556220 - DNA, 22 bp, Homo sapiens
gagagccagggaggagtgagtt

SEQ ID NO: 556221 - DNA, 22 bp, Homo sapiens
aatgtgaagtgtgagtcagctg

SEQ ID NO: 556222 - DNA, 22 bp, Homo sapiens
tgctaattggaactctactaag

SEQ ID NO: 556223 - DNA, 22 bp, Homo sapiens
ggccattgggtttctccacagg

SEQ ID NO: 556224 - DNA, 22 bp, Homo sapiens
tggtgggtgaagttatgctggg

SEQ ID NO: 556225 - DNA, 22 bp, Homo sapiens
gcatttgtgataggctctccag

SEQ ID NO: 556226 - DNA, 22 bp, Homo sapiens
tcaaatttctttttgtgcatgt

SEQ ID NO: 556227 - DNA, 22 bp, Homo sapiens
gcttgttttaaaaggtatacag

SEQ ID NO: 556228 - DNA, 22 bp, Homo sapiens
tatggaggttctagaccatgtt

SEQ ID NO: 556229 - DNA, 22 bp, Homo sapiens
gctgcagagcagtcgaacgggg

SEQ ID NO: 556230 - DNA, 22 bp, Homo sapiens
taccctccccgctcagccggcc

SEQ ID NO: 556231 - DNA, 22 bp, Homo sapiens
ccctctaggagcttcagtctgt

SEQ ID NO: 556232 - DNA, 22 bp, Homo sapiens
ggccatattctagggatttatc

SEQ ID NO: 556233 - DNA, 22 bp, Homo sapiens
tagcactgtctactctggattt

SEQ ID NO: 556234 - DNA, 22 bp, Homo sapiens
cttaacacaggaggcaaggtaa

SEQ ID NO: 556235 - DNA, 22 bp, Homo sapiens
ttctgggagcaaagactaaact

SEQ ID NO: 556236 - DNA, 22 bp, Homo sapiens
agggcctgggccagcacccttt

SEQ ID NO: 556237 - DNA, 22 bp, Homo sapiens
agttggattgtgagagctgcac

SEQ ID NO: 556238 - DNA, 22 bp, Homo sapiens
acagtacagtgtgcgcatatct

SEQ ID NO: 556239 - DNA, 22 bp, Homo sapiens
ttttaaagaaaagtatgttttg

SEQ ID NO: 556240 - DNA, 22 bp, Homo sapiens
ctttggcactgagcagcatctg

SEQ ID NO: 556241 - DNA, 22 bp, Homo sapiens
caaagaaatatcatggcatcag

SEQ ID NO: 556242 - DNA, 22 bp, Homo sapiens
ggctggaagaggagaagggacc

SEQ ID NO: 556243 - DNA, 22 bp, Homo sapiens
agagaggaaggagtggtgtctt

SEQ ID NO: 556244 - DNA, 22 bp, Homo sapiens
gtcctagggtcttctgggaact

SEQ ID NO: 556245 - DNA, 22 bp, Homo sapiens
aggtgggtgggacattccaggc

SEQ ID NO: 556246 - DNA, 22 bp, Homo sapiens
tcacttggctcatgtcttgata

SEQ ID NO: 556247 - DNA, 22 bp, Homo sapiens
taatggctggctgggaaaatgg

SEQ ID NO: 556248 - DNA, 22 bp, Homo sapiens
tggggagggttgggggaggctg

SEQ ID NO: 556249 - DNA, 22 bp, Homo sapiens
tgcacttgaggccaaggaaggt

SEQ ID NO: 556250 - DNA, 22 bp, Homo sapiens
tgatggaaagaaccaggaaagg

SEQ ID NO: 556251 - DNA, 22 bp, Homo sapiens
aggacacagaaccgtgggggca

SEQ ID NO: 556252 - DNA, 22 bp, Homo sapiens
atgtaactggggtcactgtttt

SEQ ID NO: 556253 - DNA, 22 bp, Homo sapiens
gccctgtgtgaaggtagctctt

SEQ ID NO: 556254 - DNA, 22 bp, Homo sapiens
cattaacaatctatgcttcctg

SEQ ID NO: 556255 - DNA, 22 bp, Homo sapiens
cggcccgcgtgaaccctgggcc

SEQ ID NO: 556256 - DNA, 22 bp, Homo sapiens
gatgagagtgaggatgagaagg

SEQ ID NO: 556257 - DNA, 22 bp, Homo sapiens
gctaaggcaaaagctttggcag

SEQ ID NO: 556258 - DNA, 22 bp, Homo sapiens
ttacctcggcaacgggctgcag

SEQ ID NO: 556259 - DNA, 22 bp, Homo sapiens
gtactttggcatatggccttta

SEQ ID NO: 556260 - DNA, 22 bp, Homo sapiens
acacatctatcttgggagaaaa

SEQ ID NO: 556261 - DNA, 22 bp, Homo sapiens
gggaagaacctaaaggaggtga

SEQ ID NO: 556262 - DNA, 22 bp, Homo sapiens
tcctgttccttaaaatctctgg

SEQ ID NO: 556263 - DNA, 22 bp, Homo sapiens
agcacctgcattttactcttgt

SEQ ID NO: 556264 - DNA, 22 bp, Homo sapiens
gggctgtgagctgctgtgggca

SEQ ID NO: 556265 - DNA, 22 bp, Homo sapiens
aaatgaatgttttagaggccag

SEQ ID NO: 556266 - DNA, 22 bp, Homo sapiens
cccaaaatacatggacgtgtcc

SEQ ID NO: 556267 - DNA, 22 bp, Homo sapiens
tgtgctatttctggaaatgttc

SEQ ID NO: 556268 - DNA, 22 bp, Homo sapiens
tagaggtacagtaggcatgact

SEQ ID NO: 556269 - DNA, 22 bp, Homo sapiens
ttcatttctgccagaatttaac

SEQ ID NO: 556270 - DNA, 22 bp, Homo sapiens
tgattctatgcttctgaatcat

SEQ ID NO: 556271 - DNA, 22 bp, Homo sapiens
agctaattctttcggggaccgg

SEQ ID NO: 556272 - DNA, 22 bp, Homo sapiens
gtcagaggaccttgatacagac

SEQ ID NO: 556273 - DNA, 22 bp, Homo sapiens
tgtgcagtgatccctggagtcc

SEQ ID NO: 556274 - DNA, 22 bp, Homo sapiens
aagcagaagccctgatgttaag

SEQ ID NO: 556275 - DNA, 22 bp, Homo sapiens
ctggttacagttattggcatcc

SEQ ID NO: 556276 - DNA, 22 bp, Homo sapiens
aacagccctgaaaggctggagt

SEQ ID NO: 556277 - DNA, 22 bp, Homo sapiens
aaatggtctggttgctgagtgg

SEQ ID NO: 556278 - DNA, 22 bp, Homo sapiens
cacttgtttagataataggaac

SEQ ID NO: 556279 - DNA, 22 bp, Homo sapiens
tccaacggtgtgttattaggtt

SEQ ID NO: 556280 - DNA, 22 bp, Homo sapiens
taactcgcagctgtgctaactt

SEQ ID NO: 556281 - DNA, 22 bp, Homo sapiens
ggttcagcaccccgaaagtgtc

SEQ ID NO: 556282 - DNA, 22 bp, Homo sapiens
tcatctctgttacagaggtgct

SEQ ID NO: 556283 - DNA, 22 bp, Homo sapiens
tgtgtctatctactggccctcc

SEQ ID NO: 556284 - DNA, 22 bp, Homo sapiens
tgtcccaggcaggggctgggca

SEQ ID NO: 556285 - DNA, 22 bp, Homo sapiens
ccttcttagattaactgttcct

SEQ ID NO: 556286 - DNA, 22 bp, Homo sapiens
ctttgttctgggcattgtgcta

SEQ ID NO: 556287 - DNA, 22 bp, Homo sapiens
aagtaccaggaatgtcggagtt

SEQ ID NO: 556288 - DNA, 22 bp, Homo sapiens
atcacttttgtgactatgcaac

SEQ ID NO: 556289 - DNA, 22 bp, Homo sapiens
aaagggtaggccagggaggaag

SEQ ID NO: 556290 - DNA, 22 bp, Homo sapiens
tggggccaggcccttcaggctg

SEQ ID NO: 556291 - DNA, 22 bp, Homo sapiens
cactcctggggattataggagc

SEQ ID NO: 556292 - DNA, 22 bp, Homo sapiens
tgtgctctttatcctcatctgg

SEQ ID NO: 556293 - DNA, 22 bp, Homo sapiens
tgtctggatcagtgggtgcttg

SEQ ID NO: 556294 - DNA, 22 bp, Homo sapiens
tttcagaagtcaactaggtaaa

SEQ ID NO: 556295 - DNA, 22 bp, Homo sapiens
ccttactgtggtcccacgtccc

SEQ ID NO: 556296 - DNA, 22 bp, Homo sapiens
cctggggaggggagagaggagg

SEQ ID NO: 556297 - DNA, 22 bp, Homo sapiens
tccactgcctgcctccgctgga

SEQ ID NO: 556298 - DNA, 22 bp, Homo sapiens
ggagaaaggggcgggcatctgg

SEQ ID NO: 556299 - DNA, 22 bp, Homo sapiens
tgctttaaaaggcatgctttcc

SEQ ID NO: 556300 - DNA, 22 bp, Homo sapiens
acagggctgagtgggaagggct

SEQ ID NO: 556301 - DNA, 22 bp, Homo sapiens
tgggctgggccctattaggaca

SEQ ID NO: 556302 - DNA, 22 bp, Homo sapiens
actgcttctgcatctcatcagc

SEQ ID NO: 556303 - DNA, 22 bp, Homo sapiens
tacgtatgtatcacacagttac

SEQ ID NO: 556304 - DNA, 22 bp, Homo sapiens
ataggttttatcctatgtatat

SEQ ID NO: 556305 - DNA, 22 bp, Homo sapiens
cggtgtcctggattggggtggg

SEQ ID NO: 556306 - DNA, 22 bp, Homo sapiens
caaagcgcttctctttagagtg

SEQ ID NO: 556307 - DNA, 22 bp, Homo sapiens
tggttgttgtcggcatctttcc

SEQ ID NO: 556308 - DNA, 22 bp, Homo sapiens
tgtggaagacagctgagtggat

SEQ ID NO: 556309 - DNA, 22 bp, Homo sapiens
tgtcttctctcctgctgccctg

SEQ ID NO: 556310 - DNA, 22 bp, Homo sapiens
gagatgagactaacaatcgttg

SEQ ID NO: 556311 - DNA, 22 bp, Homo sapiens
aagtgactagtttgaggcatca

SEQ ID NO: 556312 - DNA, 22 bp, Homo sapiens
agcttccttcctcatccccatc

SEQ ID NO: 556313 - DNA, 22 bp, Homo sapiens
tggacgttgttggggtgctctc

SEQ ID NO: 556314 - DNA, 22 bp, Homo sapiens
tgagctcccatatcttaccctc

SEQ ID NO: 556315 - DNA, 22 bp, Homo sapiens
agatgagccactgtcatggaga

SEQ ID NO: 556316 - DNA, 22 bp, Homo sapiens
tgatctggctcctgcttgaaag

SEQ ID NO: 556317 - DNA, 22 bp, Homo sapiens
cccctccacagaatccagaatt

SEQ ID NO: 556318 - DNA, 22 bp, Homo sapiens
gagtgtcatttaagccttttgc

SEQ ID NO: 556319 - DNA, 22 bp, Homo sapiens
ccacagagttcattacagggta

SEQ ID NO: 556320 - DNA, 22 bp, Homo sapiens
ggcaggtgggaggaggggcatc

SEQ ID NO: 556321 - DNA, 22 bp, Homo sapiens
ccctgctctggactcctggctc

SEQ ID NO: 556322 - DNA, 22 bp, Homo sapiens
aaaactttgggcttttctttgg

SEQ ID NO: 556323 - DNA, 22 bp, Homo sapiens
tcaggctgaaggcccttgcagg

SEQ ID NO: 556324 - DNA, 22 bp, Homo sapiens
ttgcttatgtcaggtgagaggg

SEQ ID NO: 556325 - DNA, 22 bp, Homo sapiens
gggcaggtctaggtctggtttg

SEQ ID NO: 556326 - DNA, 22 bp, Homo sapiens
gaggagaagtcctgcttacttc

SEQ ID NO: 556327 - DNA, 22 bp, Homo sapiens
ttccggtctatcgtgtcaatgc

SEQ ID NO: 556328 - DNA, 22 bp, Homo sapiens
tgggaaaagatgagttttggta

SEQ ID NO: 556329 - DNA, 22 bp, Homo sapiens
gcagcttgatggctgatggagg

SEQ ID NO: 556330 - DNA, 22 bp, Homo sapiens
caatttgttttagacacagtag

SEQ ID NO: 556331 - DNA, 22 bp, Homo sapiens
ttcttttttgtggggatgcttt

SEQ ID NO: 556332 - DNA, 22 bp, Homo sapiens
tgcagggaagggcatgctattg

SEQ ID NO: 556333 - DNA, 22 bp, Homo sapiens
tcccagaacccagctcacctac

SEQ ID NO: 556334 - DNA, 22 bp, Homo sapiens
tgcggatgcggtataaagacag

SEQ ID NO: 556335 - DNA, 22 bp, Homo sapiens
acaaagtgcttccctttagagt

SEQ ID NO: 556336 - DNA, 22 bp, Homo sapiens
tcctctcccctaggccatcttg

SEQ ID NO: 556337 - DNA, 22 bp, Homo sapiens
taattgtaggtcaagtctgctt

SEQ ID NO: 556338 - DNA, 22 bp, Homo sapiens
tcagagtccaggctctcctgct

SEQ ID NO: 556339 - DNA, 22 bp, Homo sapiens
cagggccgtcctgagcctgtga

SEQ ID NO: 556340 - DNA, 22 bp, Homo sapiens
aaggggatatcatgtctctttg

SEQ ID NO: 556341 - DNA, 22 bp, Homo sapiens
aactcagttgtacattcacaga

SEQ ID NO: 556342 - DNA, 22 bp, Homo sapiens
tgtgggtaagtcttggggatgg

SEQ ID NO: 556343 - DNA, 22 bp, Homo sapiens
ttcagtttggtttcccttatct

SEQ ID NO: 556344 - DNA, 22 bp, Homo sapiens
tagcaagattgtttccccatga

SEQ ID NO: 556345 - DNA, 22 bp, Homo sapiens
tcatcctctttctaggtcggaa

SEQ ID NO: 556346 - DNA, 22 bp, Homo sapiens
agccccacagagtggtagaatt

SEQ ID NO: 556347 - DNA, 22 bp, Homo sapiens
gatttaatgtggtattggggaa

SEQ ID NO: 556348 - DNA, 22 bp, Homo sapiens
ggatgccttgccaagtgtctaa

SEQ ID NO: 556349 - DNA, 22 bp, Homo sapiens
gttgtatgcagagcactgctgg

SEQ ID NO: 556350 - DNA, 22 bp, Homo sapiens
tttagccagtagcttttctatt

SEQ ID NO: 556351 - DNA, 22 bp, Homo sapiens
tccaccagcctgttccattttc

SEQ ID NO: 556352 - DNA, 22 bp, Homo sapiens
ttcttcttgtgccctgtctcat

SEQ ID NO: 556353 - DNA, 22 bp, Homo sapiens
tgaatgggatcaaaaaggctca

SEQ ID NO: 556354 - DNA, 22 bp, Homo sapiens
tgtcactggcctttgccataaa

SEQ ID NO: 556355 - DNA, 22 bp, Homo sapiens
tccagtcacatgtgtcttggag

SEQ ID NO: 556356 - DNA, 22 bp, Homo sapiens
ctgctaccggggtgggggagag

SEQ ID NO: 556357 - DNA, 22 bp, Homo sapiens
gagcttagtgttttgtcagctt

SEQ ID NO: 556358 - DNA, 22 bp, Homo sapiens
ctctatggttctctggtgtcct

SEQ ID NO: 556359 - DNA, 22 bp, Homo sapiens
tatccactacaccccgctgcct

SEQ ID NO: 556360 - DNA, 22 bp, Homo sapiens
ggtaggaagattgtttcaaatc

SEQ ID NO: 556361 - DNA, 22 bp, Homo sapiens
tgggcagcagctccgggcaccg

SEQ ID NO: 556362 - DNA, 22 bp, Homo sapiens
aacaattccaccactgtggacg

SEQ ID NO: 556363 - DNA, 22 bp, Homo sapiens
cgctgctgtttctgcacctccc

SEQ ID NO: 556364 - DNA, 22 bp, Homo sapiens
caggtcttgacaggtgtagcac

SEQ ID NO: 556365 - DNA, 22 bp, Homo sapiens
tgatgagcgcctgccagagctg

SEQ ID NO: 556366 - DNA, 22 bp, Homo sapiens
tggcctgcactgactagggcag

SEQ ID NO: 556367 - DNA, 22 bp, Homo sapiens
tggctgagcaggcacgctgcgc

SEQ ID NO: 556368 - DNA, 22 bp, Homo sapiens
tgccaagtattgtgtcctgctc

SEQ ID NO: 556369 - DNA, 22 bp, Homo sapiens
tgtggactcgagtatcaggccc

SEQ ID NO: 556370 - DNA, 22 bp, Homo sapiens
tggttgtaatttgtgttcagag

SEQ ID NO: 556371 - DNA, 22 bp, Homo sapiens
taccactgttcaataggtggaa

SEQ ID NO: 556372 - DNA, 22 bp, Homo sapiens
gaaaccctttcagctgctttct

SEQ ID NO: 556373 - DNA, 22 bp, Homo sapiens
agatgagagaattggccttaga

SEQ ID NO: 556374 - DNA, 22 bp, Homo sapiens
catcaagagagtggggagcaga

SEQ ID NO: 556375 - DNA, 22 bp, Homo sapiens
agattaaattcatactgtactg

SEQ ID NO: 556376 - DNA, 22 bp, Homo sapiens
tccggttaaccaccttggagac

SEQ ID NO: 556377 - DNA, 22 bp, Homo sapiens
tccttttcttgggattaactcc

SEQ ID NO: 556378 - DNA, 22 bp, Homo sapiens
ctatattggcaggcctagattc

SEQ ID NO: 556379 - DNA, 22 bp, Homo sapiens
tcctctgcacagctattgttcc

SEQ ID NO: 556380 - DNA, 22 bp, Homo sapiens
tctgtcatttccctgctatctc

SEQ ID NO: 556381 - DNA, 22 bp, Homo sapiens
ttctggcacctggtatcttggg

SEQ ID NO: 556382 - DNA, 22 bp, Homo sapiens
tttacccaataggctgtaacag

SEQ ID NO: 556383 - DNA, 22 bp, Homo sapiens
taatctcagagaaaggatagaa

SEQ ID NO: 556384 - DNA, 22 bp, Homo sapiens
gcctgaaggctgcggccgcgga

SEQ ID NO: 556385 - DNA, 22 bp, Homo sapiens
ttacatgtctgacagagctaga

SEQ ID NO: 556386 - DNA, 22 bp, Homo sapiens
ttccagtgatcagaaaggcaca

SEQ ID NO: 556387 - DNA, 22 bp, Homo sapiens
gggttatgtacacttcgggacc

SEQ ID NO: 556388 - DNA, 22 bp, Homo sapiens
atgccgggccccgacgccggat

SEQ ID NO: 556389 - DNA, 22 bp, Homo sapiens
agaaatcagtcattaccataga

SEQ ID NO: 556390 - DNA, 22 bp, Homo sapiens
tttctccactcgcttcctctct

SEQ ID NO: 556391 - DNA, 22 bp, Homo sapiens
ttttctatatgaactctattta

SEQ ID NO: 556392 - DNA, 22 bp, Homo sapiens
ctggctatttgggtctcatctg

SEQ ID NO: 556393 - DNA, 22 bp, Homo sapiens
aacccaactcttcacagggccg

SEQ ID NO: 556394 - DNA, 22 bp, Homo sapiens
cattactatttgcctcaagtga

SEQ ID NO: 556395 - DNA, 22 bp, Homo sapiens
ccctgtgggaagctccctccca

SEQ ID NO: 556396 - DNA, 22 bp, Homo sapiens
tctgctgaccccacctcctccc

SEQ ID NO: 556397 - DNA, 22 bp, Homo sapiens
tggtgatgcttagggagaagtg

SEQ ID NO: 556398 - DNA, 22 bp, Homo sapiens
gacacttgtctgagattggatg

SEQ ID NO: 556399 - DNA, 22 bp, Homo sapiens
ttgaaatgggggtgcctggggt

SEQ ID NO: 556400 - DNA, 22 bp, Homo sapiens
catttgagaaatccgcaggata

SEQ ID NO: 556401 - DNA, 22 bp, Homo sapiens
agacttcgtggtggtgctaaga

SEQ ID NO: 556402 - DNA, 22 bp, Homo sapiens
gctgctggttatgtagaaaatt

SEQ ID NO: 556403 - DNA, 22 bp, Homo sapiens
agccagaggcaaagcagccgca

SEQ ID NO: 556404 - DNA, 22 bp, Homo sapiens
ttttccactctgtttatctgac

SEQ ID NO: 556405 - DNA, 22 bp, Homo sapiens
gacattgcttgatgattcatag

SEQ ID NO: 556406 - DNA, 22 bp, Homo sapiens
ggtgttttattcctatggctta

SEQ ID NO: 556407 - DNA, 22 bp, Homo sapiens
actgaatcacatgctgctcttt

SEQ ID NO: 556408 - DNA, 22 bp, Homo sapiens
gggctgtacgcttcctctgtct

SEQ ID NO: 556409 - DNA, 22 bp, Homo sapiens
tcaggccatcccagataattga

SEQ ID NO: 556410 - DNA, 22 bp, Homo sapiens
tctagaatgggggctccttccg

SEQ ID NO: 556411 - DNA, 22 bp, Homo sapiens
tgacatgcgccacttagagcgg

SEQ ID NO: 556412 - DNA, 22 bp, Homo sapiens
ttttgggctaagtgctgatagt

SEQ ID NO: 556413 - DNA, 22 bp, Homo sapiens
tcctggtagcccctgcttccat

SEQ ID NO: 556414 - DNA, 22 bp, Homo sapiens
ggtcagtttcctccaggatcca

SEQ ID NO: 556415 - DNA, 22 bp, Homo sapiens
ttgtaactaaccagttactttg

SEQ ID NO: 556416 - DNA, 22 bp, Homo sapiens
gccccttcccctcctgaagggc

SEQ ID NO: 556417 - DNA, 22 bp, Homo sapiens
attccccctcctcacttgcccc

SEQ ID NO: 556418 - DNA, 22 bp, Homo sapiens
aatctggggccagctgtagatc

SEQ ID NO: 556419 - DNA, 22 bp, Homo sapiens
tgggatggatgattgatgctgc

SEQ ID NO: 556420 - DNA, 22 bp, Homo sapiens
tggatgtcaggatatctctgtg

SEQ ID NO: 556421 - DNA, 22 bp, Homo sapiens
actgtgtctggtccacagtagg

SEQ ID NO: 556422 - DNA, 22 bp, Homo sapiens
gcagcagagtctagctaggttc

SEQ ID NO: 556423 - DNA, 22 bp, Homo sapiens
tagactgactataaaggggtct

SEQ ID NO: 556424 - DNA, 22 bp, Homo sapiens
ggccagaagaggagggtgaggg

SEQ ID NO: 556425 - DNA, 22 bp, Homo sapiens
tcggggccttcttttggtttta

SEQ ID NO: 556426 - DNA, 22 bp, Homo sapiens
ctgggagagagttcctttctgc

SEQ ID NO: 556427 - DNA, 22 bp, Homo sapiens
tggccttgaagctccccccaac

SEQ ID NO: 556428 - DNA, 22 bp, Homo sapiens
ccccacctcccactcactgtgg

SEQ ID NO: 556429 - DNA, 22 bp, Homo sapiens
ggtttttgtctcaagcagacat

SEQ ID NO: 556430 - DNA, 22 bp, Homo sapiens
tctttctctcctccctgccatc

SEQ ID NO: 556431 - DNA, 22 bp, Homo sapiens
tggatcggcctgcatctcaata

SEQ ID NO: 556432 - DNA, 22 bp, Homo sapiens
tgtatagtcactgttttctcag

SEQ ID NO: 556433 - DNA, 22 bp, Homo sapiens
tcagatttccagggacccacat

SEQ ID NO: 556434 - DNA, 22 bp, Homo sapiens
tttcagttttaattcttccgga

SEQ ID NO: 556435 - DNA, 22 bp, Homo sapiens
tggctccacaggccagggtgtg

SEQ ID NO: 556436 - DNA, 22 bp, Homo sapiens
taggcagtagcttgagatataa

SEQ ID NO: 556437 - DNA, 22 bp, Homo sapiens
ttgtaaggtaaataatttataa

SEQ ID NO: 556438 - DNA, 22 bp, Homo sapiens
cagatgatatttgaagctagga

SEQ ID NO: 556439 - DNA, 22 bp, Homo sapiens
aggcaagggttggactctgtgg

SEQ ID NO: 556440 - DNA, 22 bp, Homo sapiens
tagagagccataaatttcagct

SEQ ID NO: 556441 - DNA, 22 bp, Homo sapiens
agtgggggtcagaggcctgggg

SEQ ID NO: 556442 - DNA, 22 bp, Homo sapiens
atgaaggggtctaggaggtgtc

SEQ ID NO: 556443 - DNA, 22 bp, Homo sapiens
taggggctccaggcaggggacc

SEQ ID NO: 556444 - DNA, 22 bp, Homo sapiens
agagaactaggatcaaccaaca

SEQ ID NO: 556445 - DNA, 22 bp, Homo sapiens
cctccagtgtgctagggtgggg

SEQ ID NO: 556446 - DNA, 22 bp, Homo sapiens
gtgtctgtcagccaggttccca

SEQ ID NO: 556447 - DNA, 22 bp, Homo sapiens
cctggacttgatggcttcttgg

SEQ ID NO: 556448 - DNA, 22 bp, Homo sapiens
tccgtttattgagcacttactg

SEQ ID NO: 556449 - DNA, 22 bp, Homo sapiens
aagagcacgctctatttaggag

SEQ ID NO: 556450 - DNA, 22 bp, Homo sapiens
tcctactggcctgcaattttct

SEQ ID NO: 556451 - DNA, 22 bp, Homo sapiens
tgattgtttacagctaagtctc

SEQ ID NO: 556452 - DNA, 22 bp, Homo sapiens
agagtaaggaagagggagagaa

SEQ ID NO: 556453 - DNA, 22 bp, Homo sapiens
cctgcctgtctccatccctgcc

SEQ ID NO: 556454 - DNA, 22 bp, Homo sapiens
tctgtggctatttgattctcta

SEQ ID NO: 556455 - DNA, 22 bp, Homo sapiens
agcaagtaaatctggacaggtt

SEQ ID NO: 556456 - DNA, 22 bp, Homo sapiens
caggttgttccctggaagaggg

SEQ ID NO: 556457 - DNA, 22 bp, Homo sapiens
gctcctattgagtacctgatat

SEQ ID NO: 556458 - DNA, 22 bp, Homo sapiens
tgagatgctctgccctgagtac

SEQ ID NO: 556459 - DNA, 22 bp, Homo sapiens
ccctcgttgtcccgggaataaa

SEQ ID NO: 556460 - DNA, 22 bp, Homo sapiens
tcgggggctggctgctggtacc

SEQ ID NO: 556461 - DNA, 22 bp, Homo sapiens
tacgcacactcatcaactgtgt

SEQ ID NO: 556462 - DNA, 22 bp, Homo sapiens
gggctcctccctggggcccagc

SEQ ID NO: 556463 - DNA, 22 bp, Homo sapiens
gcaagatagagtggagtgaaat

SEQ ID NO: 556464 - DNA, 22 bp, Homo sapiens
tcatggactgaaatgactgttt

SEQ ID NO: 556465 - DNA, 22 bp, Homo sapiens
aataagcgtgtggggtgtcatg

SEQ ID NO: 556466 - DNA, 22 bp, Homo sapiens
tcttttcctgctgagccaactg

SEQ ID NO: 556467 - DNA, 22 bp, Homo sapiens
ttgggagaaggtttctttctcc

SEQ ID NO: 556468 - DNA, 22 bp, Homo sapiens
gttaggcttatgtctgtagttt

SEQ ID NO: 556469 - DNA, 22 bp, Homo sapiens
ggcagttattctgtgcccccac

SEQ ID NO: 556470 - DNA, 22 bp, Homo sapiens
tgcgggctcaggacaggccggg

SEQ ID NO: 556471 - DNA, 22 bp, Homo sapiens
acatttaaattgcaggcagccc

SEQ ID NO: 556472 - DNA, 22 bp, Homo sapiens
acggcggtgtggaggagaatat

SEQ ID NO: 556473 - DNA, 22 bp, Homo sapiens
aaacagacagagccaggtgggt

SEQ ID NO: 556474 - DNA, 22 bp, Homo sapiens
taaccatgtctggtaagacgcc

SEQ ID NO: 556475 - DNA, 22 bp, Homo sapiens
tgggtttaaggattccccaatg

SEQ ID NO: 556476 - DNA, 22 bp, Homo sapiens
tatagatttaaatacgtatgta

SEQ ID NO: 556477 - DNA, 22 bp, Homo sapiens
tctctccccaaattctgggcgg

SEQ ID NO: 556478 - DNA, 22 bp, Homo sapiens
tacttctgtgagtgagaattca

SEQ ID NO: 556479 - DNA, 22 bp, Homo sapiens
tctacttctgtggctccaagac

SEQ ID NO: 556480 - DNA, 22 bp, Homo sapiens
gagagggtagattttggaagta

SEQ ID NO: 556481 - DNA, 22 bp, Homo sapiens
gcgggtgtgcagatgaaggctg

SEQ ID NO: 556482 - DNA, 22 bp, Homo sapiens
gagtaggagaggccttgtgggg

SEQ ID NO: 556483 - DNA, 22 bp, Homo sapiens
ccagctcggacccctgccacgc

SEQ ID NO: 556484 - DNA, 22 bp, Homo sapiens
tgcactccaagatgtggtggga

SEQ ID NO: 556485 - DNA, 22 bp, Homo sapiens
tttattctcatcaaaaggcata

SEQ ID NO: 556486 - DNA, 22 bp, Homo sapiens
atgggtgatgggtgtggtgtcc

SEQ ID NO: 556487 - DNA, 22 bp, Homo sapiens
ggaggcagggggaggaaggaat

SEQ ID NO: 556488 - DNA, 22 bp, Homo sapiens
tttctcatcacaaccctagggt

SEQ ID NO: 556489 - DNA, 22 bp, Homo sapiens
tactacaggttgttggagtact

SEQ ID NO: 556490 - DNA, 22 bp, Homo sapiens
gtttaacaggggactagaaaaa

SEQ ID NO: 556491 - DNA, 22 bp, Homo sapiens
aatgctcactaacagtccaacg

SEQ ID NO: 556492 - DNA, 22 bp, Homo sapiens
tgtacatttttctgggtgggaa

SEQ ID NO: 556493 - DNA, 22 bp, Homo sapiens
taatgagtgctgtggagagctg

SEQ ID NO: 556494 - DNA, 22 bp, Homo sapiens
gctagctttttgattgaattac

SEQ ID NO: 556495 - DNA, 22 bp, Homo sapiens
tcgtctcattactttatagtca

SEQ ID NO: 556496 - DNA, 22 bp, Homo sapiens
catgaaatcaagcgtgggtgag

SEQ ID NO: 556497 - DNA, 22 bp, Homo sapiens
agcgctttgttcttcgctggct

SEQ ID NO: 556498 - DNA, 22 bp, Homo sapiens
ccatggccccggaccttggcaa

SEQ ID NO: 556499 - DNA, 22 bp, Homo sapiens
gctggagtcagggagaccacta

SEQ ID NO: 556500 - DNA, 22 bp, Homo sapiens
ttttatctaataaatctgataa

SEQ ID NO: 556501 - DNA, 22 bp, Homo sapiens
ttctgtaagttacaagagagtt

SEQ ID NO: 556502 - DNA, 22 bp, Homo sapiens
tggactctgtgacactgtggta

SEQ ID NO: 556503 - DNA, 22 bp, Homo sapiens
ttcccatttgtaccttggaggt

SEQ ID NO: 556504 - DNA, 22 bp, Homo sapiens
gatgcgttggggcaggggaggt

SEQ ID NO: 556505 - DNA, 22 bp, Homo sapiens
tgggctgtgggaatccttcttt

SEQ ID NO: 556506 - DNA, 22 bp, Homo sapiens
gattctgcaattagaactcagc

SEQ ID NO: 556507 - DNA, 22 bp, Homo sapiens
tcctgctctctgctcatgggtg

SEQ ID NO: 556508 - DNA, 22 bp, Homo sapiens
gtctccgtggtcaggtgatgtc

SEQ ID NO: 556509 - DNA, 22 bp, Homo sapiens
tgatttcctataactccacagc

SEQ ID NO: 556510 - DNA, 22 bp, Homo sapiens
ttttaattgcaatcatgccctc

SEQ ID NO: 556511 - DNA, 22 bp, Homo sapiens
aaagtgcttccttttagagggt

SEQ ID NO: 556512 - DNA, 22 bp, Homo sapiens
gatgaatgagtttcctttccag

SEQ ID NO: 556513 - DNA, 22 bp, Homo sapiens
tatcctgtggacagatgataga

SEQ ID NO: 556514 - DNA, 22 bp, Homo sapiens
ggatggagagatgcagtcaagg

SEQ ID NO: 556515 - DNA, 22 bp, Homo sapiens
ttttatgggatttcctggcttt

SEQ ID NO: 556516 - DNA, 22 bp, Homo sapiens
tagggaaagggaataggcactg

SEQ ID NO: 556517 - DNA, 22 bp, Homo sapiens
tgtttggcattaggggtgggag

SEQ ID NO: 556518 - DNA, 22 bp, Homo sapiens
caggccccacttaacttgaaag

SEQ ID NO: 556519 - DNA, 22 bp, Homo sapiens
tggctgtgtcctagatttatga

SEQ ID NO: 556520 - DNA, 22 bp, Homo sapiens
tgaaaatttagcaagggcaaat

SEQ ID NO: 556521 - DNA, 22 bp, Homo sapiens
cattctcttcctcacactgcag

SEQ ID NO: 556522 - DNA, 22 bp, Homo sapiens
aaacacaagtgttcttgacaca

SEQ ID NO: 556523 - DNA, 22 bp, Homo sapiens
cccaggtctaagtaagtatgca

SEQ ID NO: 556524 - DNA, 22 bp, Homo sapiens
tctcacatatgatctgcagcca

SEQ ID NO: 556525 - DNA, 22 bp, Homo sapiens
gagaagagagacatgaaaacct

SEQ ID NO: 556526 - DNA, 22 bp, Homo sapiens
attggagtctgttttagatgag

SEQ ID NO: 556527 - DNA, 22 bp, Homo sapiens
gccccccacatctggtcaatta

SEQ ID NO: 556528 - DNA, 22 bp, Homo sapiens
ggggaagaaactgacaataaga

SEQ ID NO: 556529 - DNA, 22 bp, Homo sapiens
agcctaaaacttccttggtaga

SEQ ID NO: 556530 - DNA, 22 bp, Homo sapiens
gacaactgtccatgtccattgg

SEQ ID NO: 556531 - DNA, 22 bp, Homo sapiens
tctactgaattaatcatttctc

SEQ ID NO: 556532 - DNA, 22 bp, Homo sapiens
tggtgacatttccggctgccag

SEQ ID NO: 556533 - DNA, 22 bp, Homo sapiens
caattttgaagaaaaatggttt

SEQ ID NO: 556534 - DNA, 22 bp, Homo sapiens
aaagtgcttctctttggtgggt

SEQ ID NO: 556535 - DNA, 22 bp, Homo sapiens
tctttatatgtgtatgttacaa

SEQ ID NO: 556536 - DNA, 22 bp, Homo sapiens
ttcatgggaaagaatcacttaa

SEQ ID NO: 556537 - DNA, 22 bp, Homo sapiens
tctgtcttacctggtactgttt

SEQ ID NO: 556538 - DNA, 22 bp, Homo sapiens
ttcaaatgggatcttcagcttt

SEQ ID NO: 556539 - DNA, 22 bp, Homo sapiens
gtgtgagcatgaggagcagtga

SEQ ID NO: 556540 - DNA, 22 bp, Homo sapiens
tagaatctgtgcaaaaatccct

SEQ ID NO: 556541 - DNA, 22 bp, Homo sapiens
gctcagcttccttccttaagga

SEQ ID NO: 556542 - DNA, 22 bp, Homo sapiens
ttgtcaccagccccctccgtgt

SEQ ID NO: 556543 - DNA, 22 bp, Homo sapiens
tggtctgtgcttctaggtacaa

SEQ ID NO: 556544 - DNA, 22 bp, Homo sapiens
tcatctcttcattcattcatgc

SEQ ID NO: 556545 - DNA, 22 bp, Homo sapiens
tgtttcctctgcaaagtgcctt

SEQ ID NO: 556546 - DNA, 22 bp, Homo sapiens
tcagtcaatgggaaatgatgca

SEQ ID NO: 556547 - DNA, 22 bp, Homo sapiens
tgatctcctggctgcaggctac

SEQ ID NO: 556548 - DNA, 22 bp, Homo sapiens
tttacaaagccagataaaatct

SEQ ID NO: 556549 - DNA, 22 bp, Homo sapiens
agaacagacagctccagacgga

SEQ ID NO: 556550 - DNA, 22 bp, Homo sapiens
tgttcgtctgctagaggtcttt

SEQ ID NO: 556551 - DNA, 22 bp, Homo sapiens
ctcccttgtataaatcatttga

SEQ ID NO: 556552 - DNA, 22 bp, Homo sapiens
catttatcatcagaccttttaa

SEQ ID NO: 556553 - DNA, 22 bp, Homo sapiens
gttgctttgagatttacattag

SEQ ID NO: 556554 - DNA, 22 bp, Homo sapiens
agagtaaatagacagaaggcag

SEQ ID NO: 556555 - DNA, 22 bp, Homo sapiens
ggaccccttccagggggttaaa

SEQ ID NO: 556556 - DNA, 22 bp, Homo sapiens
ggatgcttaggatcttgccctt

SEQ ID NO: 556557 - DNA, 22 bp, Homo sapiens
tggttatttcagtaatcttaat

SEQ ID NO: 556558 - DNA, 22 bp, Homo sapiens
ctgatccaagcacagagtctac

SEQ ID NO: 556559 - DNA, 22 bp, Homo sapiens
tctgtttctttctgtctcttgg

SEQ ID NO: 556560 - DNA, 22 bp, Homo sapiens
tctatggggactgatgtcctga

SEQ ID NO: 556561 - DNA, 22 bp, Homo sapiens
tgcactacttggctttactgat

SEQ ID NO: 556562 - DNA, 22 bp, Homo sapiens
ctctaagtggcttctgtatgtt

SEQ ID NO: 556563 - DNA, 22 bp, Homo sapiens
ttggcgatcactacttagatga

SEQ ID NO: 556564 - DNA, 22 bp, Homo sapiens
tgatgtttgtgactcttttggc

SEQ ID NO: 556565 - DNA, 22 bp, Homo sapiens
tttgggggagaactatgttcat

SEQ ID NO: 556566 - DNA, 22 bp, Homo sapiens
tggtctgctttccatctctgag

SEQ ID NO: 556567 - DNA, 22 bp, Homo sapiens
agtggctgaaggtagagtccac

SEQ ID NO: 556568 - DNA, 22 bp, Homo sapiens
atttgtgactcatgaagctaaa

SEQ ID NO: 556569 - DNA, 22 bp, Homo sapiens
tatgttatatgtcaagaagctt

SEQ ID NO: 556570 - DNA, 22 bp, Homo sapiens
tgggcttcactaactgtgctgc

SEQ ID NO: 556571 - DNA, 22 bp, Homo sapiens
tggagtgagaagacctgggttc

SEQ ID NO: 556572 - DNA, 22 bp, Homo sapiens
acttatgcattactatttccag

SEQ ID NO: 556573 - DNA, 22 bp, Homo sapiens
ggtgggagtccgtagtcaacca

SEQ ID NO: 556574 - DNA, 22 bp, Homo sapiens
caaccttttgtcaaggaaatta

SEQ ID NO: 556575 - DNA, 22 bp, Homo sapiens
aaatcgcttccctttggagtgt

SEQ ID NO: 556576 - DNA, 22 bp, Homo sapiens
accaggaaggtgaaagagggtc

SEQ ID NO: 556577 - DNA, 22 bp, Homo sapiens
gaaatgtggtggttggggggta

SEQ ID NO: 556578 - DNA, 22 bp, Homo sapiens
tttatcatttctttataagaaa

SEQ ID NO: 556579 - DNA, 22 bp, Homo sapiens
aaccaagtgagtaaatgtcaag

SEQ ID NO: 556580 - DNA, 22 bp, Homo sapiens
tggggtccatacctgcagcaag

SEQ ID NO: 556581 - DNA, 22 bp, Homo sapiens
tgttctcttttcccttttacag

SEQ ID NO: 556582 - DNA, 22 bp, Homo sapiens
tgacttgtctcgcggttactgg

SEQ ID NO: 556583 - DNA, 22 bp, Homo sapiens
ggattcccagctgtctgcatga

SEQ ID NO: 556584 - DNA, 22 bp, Homo sapiens
gccgcccgggagggggcgtggg

SEQ ID NO: 556585 - DNA, 22 bp, Homo sapiens
ctgctcattaggctaattagta

SEQ ID NO: 556586 - DNA, 22 bp, Homo sapiens
tgaggttatgatgttggactag

SEQ ID NO: 556587 - DNA, 22 bp, Homo sapiens
tgggaatgcctactggtcacct

SEQ ID NO: 556588 - DNA, 22 bp, Homo sapiens
tgtgctgcgagtacgagccgga

SEQ ID NO: 556589 - DNA, 22 bp, Homo sapiens
tgcagttaatggccagtttatt

SEQ ID NO: 556590 - DNA, 22 bp, Homo sapiens
aagagtttagacttttggggca

SEQ ID NO: 556591 - DNA, 22 bp, Homo sapiens
tttatatgcatgtattactaat

SEQ ID NO: 556592 - DNA, 22 bp, Homo sapiens
caggcatggtgctgggtgctgg

SEQ ID NO: 556593 - DNA, 22 bp, Homo sapiens
acatgactgttgtctgtcttta

SEQ ID NO: 556594 - DNA, 22 bp, Homo sapiens
cataatcaaatacaagtgcagc

SEQ ID NO: 556595 - DNA, 22 bp, Homo sapiens
tgtgtgtacacctaacctacac

SEQ ID NO: 556596 - DNA, 22 bp, Homo sapiens
tcagggatttggccaaagtcag

SEQ ID NO: 556597 - DNA, 22 bp, Homo sapiens
tcctgtgctgtgcatcttgatg

SEQ ID NO: 556598 - DNA, 22 bp, Homo sapiens
gtgcccccaggccccctcagct

SEQ ID NO: 556599 - DNA, 22 bp, Homo sapiens
gccctctcctcccttcctgtcc

SEQ ID NO: 556600 - DNA, 22 bp, Homo sapiens
tatttcacctctctgaggctca

SEQ ID NO: 556601 - DNA, 22 bp, Homo sapiens
tcaagtgcttctgggattagga

SEQ ID NO: 556602 - DNA, 22 bp, Homo sapiens
acacagtaacaattttccgcta

SEQ ID NO: 556603 - DNA, 22 bp, Homo sapiens
gtctgcgcctggccctggctgt

SEQ ID NO: 556604 - DNA, 22 bp, Homo sapiens
tggcccaagaatagctggccag

SEQ ID NO: 556605 - DNA, 22 bp, Homo sapiens
ataattagttgggaaactataa

SEQ ID NO: 556606 - DNA, 22 bp, Homo sapiens
cctaaaacatgttgactcttta

SEQ ID NO: 556607 - DNA, 22 bp, Homo sapiens
tctcccttcttccaagagtctg

SEQ ID NO: 556608 - DNA, 22 bp, Homo sapiens
agtgtgtgttttatttattata

SEQ ID NO: 556609 - DNA, 22 bp, Homo sapiens
tctgattcattgaacgttctga

SEQ ID NO: 556610 - DNA, 22 bp, Homo sapiens
aggcccttcagcccttggaagg

SEQ ID NO: 556611 - DNA, 22 bp, Homo sapiens
tgatgtagtttttggaggaaaa

SEQ ID NO: 556612 - DNA, 22 bp, Homo sapiens
tggagcacatataagaataggg

SEQ ID NO: 556613 - DNA, 22 bp, Homo sapiens
tattatcccgtttggtaatctg

SEQ ID NO: 556614 - DNA, 22 bp, Homo sapiens
tttttcttccttcaatctcttt

SEQ ID NO: 556615 - DNA, 22 bp, Homo sapiens
gggagaaaggaaggaacagggg

SEQ ID NO: 556616 - DNA, 22 bp, Homo sapiens
tggcaaataccatctgagatga

SEQ ID NO: 556617 - DNA, 22 bp, Homo sapiens
actggttcctatgccaggctgt

SEQ ID NO: 556618 - DNA, 22 bp, Homo sapiens
tacaattctataatttgacaat

SEQ ID NO: 556619 - DNA, 22 bp, Homo sapiens
acgtgctctctgtcatggcagg

SEQ ID NO: 556620 - DNA, 22 bp, Homo sapiens
actgttcttcttcaaagtcttt

SEQ ID NO: 556621 - DNA, 22 bp, Homo sapiens
tctgggctgtctcaggtgttca

SEQ ID NO: 556622 - DNA, 22 bp, Homo sapiens
tcctagaagaaggcagacatga

SEQ ID NO: 556623 - DNA, 22 bp, Homo sapiens
gggggtgggtcatgggctctaa

SEQ ID NO: 556624 - DNA, 22 bp, Homo sapiens
gatatctatgaatgtatgtgca

SEQ ID NO: 556625 - DNA, 22 bp, Homo sapiens
tggagtatgtcagcagacattc

SEQ ID NO: 556626 - DNA, 22 bp, Homo sapiens
agcagtgtttgccagaaccggg

SEQ ID NO: 556627 - DNA, 22 bp, Homo sapiens
taccttctttctctttctccat

SEQ ID NO: 556628 - DNA, 22 bp, Homo sapiens
tgatgcttctcttgctgggtca

SEQ ID NO: 556629 - DNA, 22 bp, Homo sapiens
caattgggctagctgctcttca

SEQ ID NO: 556630 - DNA, 22 bp, Homo sapiens
taattcctaggcaatatttaga

SEQ ID NO: 556631 - DNA, 22 bp, Homo sapiens
tgtttttctcctgtatgactca

SEQ ID NO: 556632 - DNA, 22 bp, Homo sapiens
agttttccattttgtttcacat

SEQ ID NO: 556633 - DNA, 22 bp, Homo sapiens
tccaatgtgcctgtctttttct

SEQ ID NO: 556634 - DNA, 22 bp, Homo sapiens
catctctttctctccacgagcg

SEQ ID NO: 556635 - DNA, 22 bp, Homo sapiens
tgctgtggagaatacaggtgct

SEQ ID NO: 556636 - DNA, 22 bp, Homo sapiens
ctgtggcagttatttattttac

SEQ ID NO: 556637 - DNA, 22 bp, Homo sapiens
tgagccccttctctctctccag

SEQ ID NO: 556638 - DNA, 22 bp, Homo sapiens
ccctggtttgtactcccccacc

SEQ ID NO: 556639 - DNA, 22 bp, Homo sapiens
tggctgtgagggtttataggat

SEQ ID NO: 556640 - DNA, 22 bp, Homo sapiens
cagtcaatttgctgccatggga

SEQ ID NO: 556641 - DNA, 22 bp, Homo sapiens
ttccatcctcttccctcatcct

SEQ ID NO: 556642 - DNA, 22 bp, Homo sapiens
ttgacctgagaggtaaatattg

SEQ ID NO: 556643 - DNA, 22 bp, Homo sapiens
ttgtagttaccgtgtgtatgtg

SEQ ID NO: 556644 - DNA, 22 bp, Homo sapiens
tgagatgcttgaagagatggat

SEQ ID NO: 556645 - DNA, 22 bp, Homo sapiens
ggtttcagatgctggcaggcat

SEQ ID NO: 556646 - DNA, 22 bp, Homo sapiens
tgtggtaaagctgcttattgtt

SEQ ID NO: 556647 - DNA, 22 bp, Homo sapiens
ccagtcagtgtgggatgggcca

SEQ ID NO: 556648 - DNA, 22 bp, Homo sapiens
tggttgcttccagtgcctgttt

SEQ ID NO: 556649 - DNA, 22 bp, Homo sapiens
cttctaagtattcagatagttg

SEQ ID NO: 556650 - DNA, 22 bp, Homo sapiens
tagtgggttgttgtgggatctt

SEQ ID NO: 556651 - DNA, 22 bp, Homo sapiens
tcactccccgctccgtgcctag

SEQ ID NO: 556652 - DNA, 22 bp, Homo sapiens
tgtgtgattgcaggagatgtgg

SEQ ID NO: 556653 - DNA, 22 bp, Homo sapiens
tggtggggctggagggcgcgcc

SEQ ID NO: 556654 - DNA, 22 bp, Homo sapiens
tttttattgaaacatcagaatc

SEQ ID NO: 556655 - DNA, 22 bp, Homo sapiens
gaggttccttaggagggagttc

SEQ ID NO: 556656 - DNA, 22 bp, Homo sapiens
tttgttttgctctgggctggga

SEQ ID NO: 556657 - DNA, 22 bp, Homo sapiens
agtttgctgttgctgggtatga

SEQ ID NO: 556658 - DNA, 22 bp, Homo sapiens
tgcctggcccccagggacctgg

SEQ ID NO: 556659 - DNA, 22 bp, Homo sapiens
gctttggctctagcagacagga

SEQ ID NO: 556660 - DNA, 22 bp, Homo sapiens
tcaaaattgaaccttctcagac

SEQ ID NO: 556661 - DNA, 22 bp, Homo sapiens
ttccaaggatatggttgatccc

SEQ ID NO: 556662 - DNA, 22 bp, Homo sapiens
tttattattaatgttttgtggc

SEQ ID NO: 556663 - DNA, 22 bp, Homo sapiens
ttatggtgcctctttaaatgtc

SEQ ID NO: 556664 - DNA, 22 bp, Homo sapiens
aattgcacggtatccatctgta

SEQ ID NO: 556665 - DNA, 22 bp, Homo sapiens
tacacctttgaaaacaagccac

SEQ ID NO: 556666 - DNA, 22 bp, Homo sapiens
ttacatgcatgcctgccacatg

SEQ ID NO: 556667 - DNA, 22 bp, Homo sapiens
aacctcaaagcccttactgctt

SEQ ID NO: 556668 - DNA, 22 bp, Homo sapiens
atgaagttttcttgaataggct

SEQ ID NO: 556669 - DNA, 22 bp, Homo sapiens
tcctcatagaattgatagcttt

SEQ ID NO: 556670 - DNA, 22 bp, Homo sapiens
gaggtcagaggaggccaaggcc

SEQ ID NO: 556671 - DNA, 22 bp, Homo sapiens
accgattctgaagtgtcccctc

SEQ ID NO: 556672 - DNA, 22 bp, Homo sapiens
actgcctgacaattgtcactgt

SEQ ID NO: 556673 - DNA, 22 bp, Homo sapiens
aggaaaggctggagtgggaggt

SEQ ID NO: 556674 - DNA, 22 bp, Homo sapiens
aaaggaagagactgaggtggga

SEQ ID NO: 556675 - DNA, 22 bp, Homo sapiens
gctgggctgacgggggagcagc

SEQ ID NO: 556676 - DNA, 22 bp, Homo sapiens
gctgcccgccagctgtgagcgc

SEQ ID NO: 556677 - DNA, 22 bp, Homo sapiens
aagctcacagtctagttgtgtt

SEQ ID NO: 556678 - DNA, 22 bp, Homo sapiens
tgatgtgttgggtgaagagctc

SEQ ID NO: 556679 - DNA, 22 bp, Homo sapiens
gagactgagggctaccccgggg

SEQ ID NO: 556680 - DNA, 22 bp, Homo sapiens
caggcctgctgttgcccagctt

SEQ ID NO: 556681 - DNA, 22 bp, Homo sapiens
gaaatgtgaaggagtggtttga

SEQ ID NO: 556682 - DNA, 22 bp, Homo sapiens
caacgaggacaagtctaaggca

SEQ ID NO: 556683 - DNA, 22 bp, Homo sapiens
gcacagtgtggccaccttcagt

SEQ ID NO: 556684 - DNA, 22 bp, Homo sapiens
cagcaggagacacacaagtccc

SEQ ID NO: 556685 - DNA, 22 bp, Homo sapiens
gcgcaggggagtctcaggtggg

SEQ ID NO: 556686 - DNA, 22 bp, Homo sapiens
tgtgggggtggtgtgggggagg

SEQ ID NO: 556687 - DNA, 22 bp, Homo sapiens
caggtggggcgggctgggaggc

SEQ ID NO: 556688 - DNA, 22 bp, Homo sapiens
gttatattggttgagaatttgg

SEQ ID NO: 556689 - DNA, 22 bp, Homo sapiens
ggtgtcccctggtcccctttcc

SEQ ID NO: 556690 - DNA, 22 bp, Homo sapiens
tacttagctgcgtggtagaatg

SEQ ID NO: 556691 - DNA, 22 bp, Homo sapiens
tcaggagcccaagactgtacag

SEQ ID NO: 556692 - DNA, 22 bp, Homo sapiens
taaggagacagtttgcaacttg

SEQ ID NO: 556693 - DNA, 22 bp, Homo sapiens
ttttcatggcgaggcttcatgg

SEQ ID NO: 556694 - DNA, 22 bp, Homo sapiens
tcatctcccttcttggagtctc

SEQ ID NO: 556695 - DNA, 22 bp, Homo sapiens
taatgaatgtcttttgttactc

SEQ ID NO: 556696 - DNA, 22 bp, Homo sapiens
agatgagacctactaatatgct

SEQ ID NO: 556697 - DNA, 22 bp, Homo sapiens
tccatggacacgagagcccctg

SEQ ID NO: 556698 - DNA, 22 bp, Homo sapiens
ggtagcatggagagctcctggc

SEQ ID NO: 556699 - DNA, 22 bp, Homo sapiens
actcagtttttggcctctgctg

SEQ ID NO: 556700 - DNA, 22 bp, Homo sapiens
ccaaactatggatggacgaaga

SEQ ID NO: 556701 - DNA, 22 bp, Homo sapiens
ctgtgctgtgcatgtacttaag

SEQ ID NO: 556702 - DNA, 22 bp, Homo sapiens
ttctcctgctctatttattcag

SEQ ID NO: 556703 - DNA, 22 bp, Homo sapiens
agattggaaacgcagatgaggt

SEQ ID NO: 556704 - DNA, 22 bp, Homo sapiens
tgttacaaagcattcagcatga

SEQ ID NO: 556705 - DNA, 22 bp, Homo sapiens
tgaagtcgttttcagaaagaca

SEQ ID NO: 556706 - DNA, 22 bp, Homo sapiens
gcctcccaagctgggcctcccc

SEQ ID NO: 556707 - DNA, 22 bp, Homo sapiens
tctgacaagcatgctatgtgct

SEQ ID NO: 556708 - DNA, 22 bp, Homo sapiens
gggaccagctccaggggaaggg

SEQ ID NO: 556709 - DNA, 22 bp, Homo sapiens
agttgatgacaatattgtagat

SEQ ID NO: 556710 - DNA, 22 bp, Homo sapiens
ccctacgctgctgcttcccgac

SEQ ID NO: 556711 - DNA, 22 bp, Homo sapiens
catttttcacagcaacagctct

SEQ ID NO: 556712 - DNA, 22 bp, Homo sapiens
aagtcagcgtgtgtgtgcatgc

SEQ ID NO: 556713 - DNA, 22 bp, Homo sapiens
tgaattattcagataattacct

SEQ ID NO: 556714 - DNA, 22 bp, Homo sapiens
ggggtcacagactcctggtagc

SEQ ID NO: 556715 - DNA, 22 bp, Homo sapiens
gcatagatcaatgcactgaagc

SEQ ID NO: 556716 - DNA, 22 bp, Homo sapiens
tcatgggaggcactgctggagc

SEQ ID NO: 556717 - DNA, 22 bp, Homo sapiens
atgcctgttagctgcactgtct

SEQ ID NO: 556718 - DNA, 22 bp, Homo sapiens
gatctttttatttaccctgtta

SEQ ID NO: 556719 - DNA, 22 bp, Homo sapiens
tgccgagactagagtcacatcc

SEQ ID NO: 556720 - DNA, 22 bp, Homo sapiens
tgcttactcaagtcacactcct

SEQ ID NO: 556721 - DNA, 22 bp, Homo sapiens
tcaggagcctttttccacccat

SEQ ID NO: 556722 - DNA, 22 bp, Homo sapiens
agggagggagcaggagagggaa

SEQ ID NO: 556723 - DNA, 22 bp, Homo sapiens
ctgaaacaaattaaagcctctt

SEQ ID NO: 556724 - DNA, 22 bp, Homo sapiens
tggggggctgggagagtaaaag

SEQ ID NO: 556725 - DNA, 22 bp, Homo sapiens
cctgagactaggtttatttgcc

SEQ ID NO: 556726 - DNA, 22 bp, Homo sapiens
gggaaaagagagaatttatagc

SEQ ID NO: 556727 - DNA, 22 bp, Homo sapiens
tggacccagtgcttgcttctag

SEQ ID NO: 556728 - DNA, 22 bp, Homo sapiens
tgaatgatgagctcacatctgt

SEQ ID NO: 556729 - DNA, 22 bp, Homo sapiens
agcaaggaggagtgtgtggctt

SEQ ID NO: 556730 - DNA, 22 bp, Homo sapiens
ttctttcagatgactttgggaa

SEQ ID NO: 556731 - DNA, 22 bp, Homo sapiens
actgtactcttatagccatctg

SEQ ID NO: 556732 - DNA, 22 bp, Homo sapiens
tgttgtctttcttctggcagtt

SEQ ID NO: 556733 - DNA, 22 bp, Homo sapiens
aatgattatttctcagagtaga

SEQ ID NO: 556734 - DNA, 22 bp, Homo sapiens
acgttgtgacagaagcaatgat

SEQ ID NO: 556735 - DNA, 22 bp, Homo sapiens
tcctccttgtgtattggcaggg

SEQ ID NO: 556736 - DNA, 22 bp, Homo sapiens
tgggatgtttataggcaagttt

SEQ ID NO: 556737 - DNA, 22 bp, Homo sapiens
tctaataactacagcccttcag

SEQ ID NO: 556738 - DNA, 22 bp, Homo sapiens
taataagaaaggttcttgggag

SEQ ID NO: 556739 - DNA, 22 bp, Homo sapiens
gctgggcttcccaccactgcaa

SEQ ID NO: 556740 - DNA, 22 bp, Homo sapiens
tcttccaagaaaaactcatcta

SEQ ID NO: 556741 - DNA, 22 bp, Homo sapiens
tctggtttccagggcagatgcc

SEQ ID NO: 556742 - DNA, 22 bp, Homo sapiens
agtcaggggaggggtggagaga

SEQ ID NO: 556743 - DNA, 22 bp, Homo sapiens
gctataaccatttttctgccct

SEQ ID NO: 556744 - DNA, 22 bp, Homo sapiens
tgggtgctcatggagcagatta

SEQ ID NO: 556745 - DNA, 22 bp, Homo sapiens
taaaaggccccagaaaagcatc

SEQ ID NO: 556746 - DNA, 22 bp, Homo sapiens
gagaggggcgggaggagagcgg

SEQ ID NO: 556747 - DNA, 22 bp, Homo sapiens
tcgccgttgcccatggcttcgc

SEQ ID NO: 556748 - DNA, 22 bp, Homo sapiens
ttaagtactattgttcagttta

SEQ ID NO: 556749 - DNA, 22 bp, Homo sapiens
tgggaaggggaaggtcctctcc

SEQ ID NO: 556750 - DNA, 22 bp, Homo sapiens
tcatgtgttctacaaacctgta

SEQ ID NO: 556751 - DNA, 22 bp, Homo sapiens
atcacactagaaaatcctggat

SEQ ID NO: 556752 - DNA, 22 bp, Homo sapiens
tttcaggagtacattttcactt

SEQ ID NO: 556753 - DNA, 22 bp, Homo sapiens
cacagttccaggtgccctgtcc

SEQ ID NO: 556754 - DNA, 22 bp, Homo sapiens
tcttgctctattaggcaaatga

SEQ ID NO: 556755 - DNA, 22 bp, Homo sapiens
tgggaggcaggggctggagggc

SEQ ID NO: 556756 - DNA, 22 bp, Homo sapiens
cctctctttacttaagggactg

SEQ ID NO: 556757 - DNA, 22 bp, Homo sapiens
tcccccgggtaaagcagcccat

SEQ ID NO: 556758 - DNA, 22 bp, Homo sapiens
ggagagtgggattagggaacag

SEQ ID NO: 556759 - DNA, 22 bp, Homo sapiens
tgtgagctgttgaaagaacctg

SEQ ID NO: 556760 - DNA, 22 bp, Homo sapiens
atggaacagagtaaggcaaatc

SEQ ID NO: 556761 - DNA, 22 bp, Homo sapiens
caggcaggtgtcccgggcatca

SEQ ID NO: 556762 - DNA, 22 bp, Homo sapiens
cgctgatcaataagaagattaa

SEQ ID NO: 556763 - DNA, 22 bp, Homo sapiens
agcagattttcccagtaagtaa

SEQ ID NO: 556764 - DNA, 22 bp, Homo sapiens
catccaaatgaagttttcattc

SEQ ID NO: 556765 - DNA, 22 bp, Homo sapiens
ctgctccagggtctgctggaga

SEQ ID NO: 556766 - DNA, 22 bp, Homo sapiens
gcaacatcccacattgtttatt

SEQ ID NO: 556767 - DNA, 22 bp, Homo sapiens
tctcttgtcttaatacttagga

SEQ ID NO: 556768 - DNA, 22 bp, Homo sapiens
gggagttccttgttgaccagaa

SEQ ID NO: 556769 - DNA, 22 bp, Homo sapiens
agggcactgacgggcggctccc

SEQ ID NO: 556770 - DNA, 22 bp, Homo sapiens
taagacagttctgtatattctt

SEQ ID NO: 556771 - DNA, 22 bp, Homo sapiens
aggctggctaccacttgagact

SEQ ID NO: 556772 - DNA, 22 bp, Homo sapiens
catgccaggcactgttctaaag

SEQ ID NO: 556773 - DNA, 22 bp, Homo sapiens
tgctgcagtcaggagtggggtg

SEQ ID NO: 556774 - DNA, 22 bp, Homo sapiens
tgtaaggcacagctgtataggc

SEQ ID NO: 556775 - DNA, 22 bp, Homo sapiens
tgggtcccttaaagaggtgata

SEQ ID NO: 556776 - DNA, 22 bp, Homo sapiens
ttccccaggtcatcagccagaa

SEQ ID NO: 556777 - DNA, 22 bp, Homo sapiens
agtgcaagaaaacattgaacct

SEQ ID NO: 556778 - DNA, 22 bp, Homo sapiens
caggcgtctgtctacgtggctt

SEQ ID NO: 556779 - DNA, 22 bp, Homo sapiens
gggattctccttttatatggca

SEQ ID NO: 556780 - DNA, 22 bp, Homo sapiens
tggggatttgtctacctctttg

SEQ ID NO: 556781 - DNA, 22 bp, Homo sapiens
ttcgtctccccttccctcccat

SEQ ID NO: 556782 - DNA, 22 bp, Homo sapiens
ggctgactctgtgctgtcacag

SEQ ID NO: 556783 - DNA, 22 bp, Homo sapiens
actttcaagtacccagaggttt

SEQ ID NO: 556784 - DNA, 22 bp, Homo sapiens
cctgggtggtggggctggggtt

SEQ ID NO: 556785 - DNA, 22 bp, Homo sapiens
tcttggccagggcacactgttt

SEQ ID NO: 556786 - DNA, 22 bp, Homo sapiens
tttgatatttcctcacttgtga

SEQ ID NO: 556787 - DNA, 22 bp, Homo sapiens
taaatgcctcccaatgattgct

SEQ ID NO: 556788 - DNA, 22 bp, Homo sapiens
gttggggtcatgggccatgaat

SEQ ID NO: 556789 - DNA, 22 bp, Homo sapiens
gggtgccagcctgccctgctag

SEQ ID NO: 556790 - DNA, 22 bp, Homo sapiens
tggggcttctattcccctgcgc

SEQ ID NO: 556791 - DNA, 22 bp, Homo sapiens
gtttcagcccaaaggtgagcat

SEQ ID NO: 556792 - DNA, 22 bp, Homo sapiens
tgcaagcaacagagcttcctgg

SEQ ID NO: 556793 - DNA, 22 bp, Homo sapiens
tactcaagtgaggtctcttggg

SEQ ID NO: 556794 - DNA, 22 bp, Homo sapiens
ttctggttcactagactgacac

SEQ ID NO: 556795 - DNA, 22 bp, Homo sapiens
ctttgatttctaatgtgccttc

SEQ ID NO: 556796 - DNA, 22 bp, Homo sapiens
attggaatattagtacagggtt

SEQ ID NO: 556797 - DNA, 22 bp, Homo sapiens
tggtttcctttgataaaaagtt

SEQ ID NO: 556798 - DNA, 22 bp, Homo sapiens
tactatacctcagttttatcag

SEQ ID NO: 556799 - DNA, 22 bp, Homo sapiens
ggtgccagatagagctgtaggt

SEQ ID NO: 556800 - DNA, 22 bp, Homo sapiens
gaaggttgcagttggatgtgac

SEQ ID NO: 556801 - DNA, 22 bp, Homo sapiens
tcaccagtgggctgatagtccc

SEQ ID NO: 556802 - DNA, 22 bp, Homo sapiens
cctattaagagaagccccattt

SEQ ID NO: 556803 - DNA, 22 bp, Homo sapiens
ttacagtctagtaagtaaataa

SEQ ID NO: 556804 - DNA, 22 bp, Homo sapiens
tctggccacccgcggtgcagca

SEQ ID NO: 556805 - DNA, 22 bp, Homo sapiens
tgatagggcctgaggtaagctg

SEQ ID NO: 556806 - DNA, 22 bp, Homo sapiens
tcacttcttggaggctcagtct

SEQ ID NO: 556807 - DNA, 22 bp, Homo sapiens
aggtagcttttttctgtgtgtt

SEQ ID NO: 556808 - DNA, 22 bp, Homo sapiens
tcaaatcacatttttcaagcct

SEQ ID NO: 556809 - DNA, 22 bp, Homo sapiens
agactgtggcatttgctggatt

SEQ ID NO: 556810 - DNA, 22 bp, Homo sapiens
tgccaggtgctttcctctagag

SEQ ID NO: 556811 - DNA, 22 bp, Homo sapiens
tctcatccttggggctgctgct

SEQ ID NO: 556812 - DNA, 22 bp, Homo sapiens
tatacttataaataatgtggtt

SEQ ID NO: 556813 - DNA, 22 bp, Homo sapiens
tgcacgtttgagcaaacaaata

SEQ ID NO: 556814 - DNA, 22 bp, Homo sapiens
tttctgcagacatccttggccg

SEQ ID NO: 556815 - DNA, 22 bp, Homo sapiens
gaaaagccctgtcggctccctc

SEQ ID NO: 556816 - DNA, 22 bp, Homo sapiens
ccttccaaagcaatactcacca

SEQ ID NO: 556817 - DNA, 22 bp, Homo sapiens
tggttttggttcagaaacaagt

SEQ ID NO: 556818 - DNA, 22 bp, Homo sapiens
tccagcaggaggagatgctaaa

SEQ ID NO: 556819 - DNA, 22 bp, Homo sapiens
tgaggaagaggggtgctggact

SEQ ID NO: 556820 - DNA, 22 bp, Homo sapiens
cacctccttcaggttcttccct

SEQ ID NO: 556821 - DNA, 22 bp, Homo sapiens
acagcaggtgcttgggaaaggc

SEQ ID NO: 556822 - DNA, 22 bp, Homo sapiens
ttgctgttaggcccagggctgg

SEQ ID NO: 556823 - DNA, 22 bp, Homo sapiens
gtgtgacatagcagagtggttt

SEQ ID NO: 556824 - DNA, 22 bp, Homo sapiens
tggaataaatacagggtttggt

SEQ ID NO: 556825 - DNA, 22 bp, Homo sapiens
gagtcctgaaggaaccatttat

SEQ ID NO: 556826 - DNA, 22 bp, Homo sapiens
gctcctccactccaggtccttg

SEQ ID NO: 556827 - DNA, 22 bp, Homo sapiens
gatggttgatcagagaacgtac

SEQ ID NO: 556828 - DNA, 22 bp, Homo sapiens
tgccactgcctcatctctttcc

SEQ ID NO: 556829 - DNA, 22 bp, Homo sapiens
ttgccatagttatagccatgat

SEQ ID NO: 556830 - DNA, 22 bp, Homo sapiens
gtttcatggcttgttaagtccc

SEQ ID NO: 556831 - DNA, 22 bp, Homo sapiens
ggaagagtgggagaatttgggg

SEQ ID NO: 556832 - DNA, 22 bp, Homo sapiens
taagatagaattctggcagtta

SEQ ID NO: 556833 - DNA, 22 bp, Homo sapiens
cctcttccccagctccccacct

SEQ ID NO: 556834 - DNA, 22 bp, Homo sapiens
ggaggagtgcgggccggagggt

SEQ ID NO: 556835 - DNA, 22 bp, Homo sapiens
tccctttatgcaccaagttccc

SEQ ID NO: 556836 - DNA, 22 bp, Homo sapiens
agtggaaggaaaaagagcagat

SEQ ID NO: 556837 - DNA, 22 bp, Homo sapiens
tataagtgtgatgggaatgaat

SEQ ID NO: 556838 - DNA, 22 bp, Homo sapiens
gaggcgttgggtggagctgcct

SEQ ID NO: 556839 - DNA, 22 bp, Homo sapiens
caggaacagcagggttgtgagg

SEQ ID NO: 556840 - DNA, 22 bp, Homo sapiens
tgctgaaatgctttgtaatatg

SEQ ID NO: 556841 - DNA, 22 bp, Homo sapiens
tggagagtgtagagagagaggt

SEQ ID NO: 556842 - DNA, 22 bp, Homo sapiens
tgggctccaggacagggtgcgg

SEQ ID NO: 556843 - DNA, 22 bp, Homo sapiens
gctccagagatgctgtgcagag

SEQ ID NO: 556844 - DNA, 22 bp, Homo sapiens
gggggaagttggggaggaatga

SEQ ID NO: 556845 - DNA, 22 bp, Homo sapiens
cctttttcggaatccggcagct

SEQ ID NO: 556846 - DNA, 22 bp, Homo sapiens
ccgccccaggggctgcagggaa

SEQ ID NO: 556847 - DNA, 22 bp, Homo sapiens
ccagactacccaggtttctatc

SEQ ID NO: 556848 - DNA, 22 bp, Homo sapiens
tgtgtccctctctgcattaagt

SEQ ID NO: 556849 - DNA, 22 bp, Homo sapiens
tcactctacacagatagaatgg

SEQ ID NO: 556850 - DNA, 22 bp, Homo sapiens
tcacagctgctttgcagtagag

SEQ ID NO: 556851 - DNA, 22 bp, Homo sapiens
tgctcttgattattcaaggtct

SEQ ID NO: 556852 - DNA, 22 bp, Homo sapiens
cagtactgtcaatcttacttgg

SEQ ID NO: 556853 - DNA, 22 bp, Homo sapiens
cacaataaatgtttgctgatga

SEQ ID NO: 556854 - DNA, 22 bp, Homo sapiens
attttcaagtgtgttttgtaac

SEQ ID NO: 556855 - DNA, 22 bp, Homo sapiens
tcacgatgactcagcacttcct

SEQ ID NO: 556856 - DNA, 22 bp, Homo sapiens
cctttcttcttcagccctgggg

SEQ ID NO: 556857 - DNA, 22 bp, Homo sapiens
aaaagaggcaatagaagatgct

SEQ ID NO: 556858 - DNA, 22 bp, Homo sapiens
gtttgggtggagagtgtcctgg

SEQ ID NO: 556859 - DNA, 22 bp, Homo sapiens
catttggaaacgtcctagttat

SEQ ID NO: 556860 - DNA, 22 bp, Homo sapiens
tccccactctggaagaacttga

SEQ ID NO: 556861 - DNA, 22 bp, Homo sapiens
ggcttccggccttgcactctct

SEQ ID NO: 556862 - DNA, 22 bp, Homo sapiens
tatatgcccatggactgcatgg

SEQ ID NO: 556863 - DNA, 22 bp, Homo sapiens
aatggaggagggatggattgtt

SEQ ID NO: 556864 - DNA, 22 bp, Homo sapiens
ttggaaatggggagaacagatt

SEQ ID NO: 556865 - DNA, 22 bp, Homo sapiens
ttttcctctccacttcctgttc

SEQ ID NO: 556866 - DNA, 22 bp, Homo sapiens
ggtgctgtgactgaagagcctg

SEQ ID NO: 556867 - DNA, 22 bp, Homo sapiens
gactgagggatggtgggcttgt

SEQ ID NO: 556868 - DNA, 22 bp, Homo sapiens
gggagaagcaattttatctagg

SEQ ID NO: 556869 - DNA, 22 bp, Homo sapiens
atgcctggtgtatttgagaaac

SEQ ID NO: 556870 - DNA, 22 bp, Homo sapiens
cctgcatggcctcagcgcttgt

SEQ ID NO: 556871 - DNA, 22 bp, Homo sapiens
cctctagatgtacttcttggct

SEQ ID NO: 556872 - DNA, 22 bp, Homo sapiens
ggtgtctgacttggccattcag

SEQ ID NO: 556873 - DNA, 22 bp, Homo sapiens
ttgggattcagcaggaccattc

SEQ ID NO: 556874 - DNA, 22 bp, Homo sapiens
tcttttgctctgaggctgtaca

SEQ ID NO: 556875 - DNA, 22 bp, Homo sapiens
acccgtgcgctttgctttcctt

SEQ ID NO: 556876 - DNA, 22 bp, Homo sapiens
tgggagagagaaaatgtgtgtg

SEQ ID NO: 556877 - DNA, 22 bp, Homo sapiens
cgattttccatccattactggg

SEQ ID NO: 556878 - DNA, 22 bp, Homo sapiens
gggctgggagatcactctggtg

SEQ ID NO: 556879 - DNA, 22 bp, Homo sapiens
tatctaagttaggataactgtc

SEQ ID NO: 556880 - DNA, 22 bp, Homo sapiens
tagtaccagtaccttgtgttca

SEQ ID NO: 556881 - DNA, 22 bp, Homo sapiens
ttggtattaatgggaaattaac

SEQ ID NO: 556882 - DNA, 22 bp, Homo sapiens
gctgggagttgggggatattca

SEQ ID NO: 556883 - DNA, 22 bp, Homo sapiens
gtttttgccttatcagtcagag

SEQ ID NO: 556884 - DNA, 22 bp, Homo sapiens
ttcccatcctccatgcatggga

SEQ ID NO: 556885 - DNA, 22 bp, Homo sapiens
tctgacactctcaggatgtggg

SEQ ID NO: 556886 - DNA, 22 bp, Homo sapiens
ccattaaccccagctggtcatc

SEQ ID NO: 556887 - DNA, 22 bp, Homo sapiens
cgggaaggcagtgggaggaact

SEQ ID NO: 556888 - DNA, 22 bp, Homo sapiens
tgaggggagttggagggggatg

SEQ ID NO: 556889 - DNA, 22 bp, Homo sapiens
aattaatagagataggcttcga

SEQ ID NO: 556890 - DNA, 22 bp, Homo sapiens
tcccgtttccatcagctgctca

SEQ ID NO: 556891 - DNA, 22 bp, Homo sapiens
ctctaattccttctgctccttc

SEQ ID NO: 556892 - DNA, 22 bp, Homo sapiens
aactgagccggccttgtgtctg

SEQ ID NO: 556893 - DNA, 22 bp, Homo sapiens
ccctttcctgtgcccttttaag

SEQ ID NO: 556894 - DNA, 22 bp, Homo sapiens
tcttcttcactgctctagatgt

SEQ ID NO: 556895 - DNA, 22 bp, Homo sapiens
tgcgcagatgcactctgaccac

SEQ ID NO: 556896 - DNA, 22 bp, Homo sapiens
ccctgtggggcctggccacccc

SEQ ID NO: 556897 - DNA, 22 bp, Homo sapiens
ctgcctttctttgagagagagt

SEQ ID NO: 556898 - DNA, 22 bp, Homo sapiens
gtgcttgctaggtgccaagcac

SEQ ID NO: 556899 - DNA, 22 bp, Homo sapiens
taaatatgataaggagtttcag

SEQ ID NO: 556900 - DNA, 22 bp, Homo sapiens
ggagtgggcagatttgggtcca

SEQ ID NO: 556901 - DNA, 22 bp, Homo sapiens
ggtatgggtgatctgaatattg

SEQ ID NO: 556902 - DNA, 22 bp, Homo sapiens
ttggcttcgtctttgatcccat

SEQ ID NO: 556903 - DNA, 22 bp, Homo sapiens
agataaccgtctgatcatgact

SEQ ID NO: 556904 - DNA, 22 bp, Homo sapiens
cagctgtgatgctgtaggagac

SEQ ID NO: 556905 - DNA, 22 bp, Homo sapiens
tcctcccaggttctatctcctc

SEQ ID NO: 556906 - DNA, 22 bp, Homo sapiens
gtgcccttttgtggaggaggct

SEQ ID NO: 556907 - DNA, 22 bp, Homo sapiens
ggagagaccttgtcatactgta

SEQ ID NO: 556908 - DNA, 22 bp, Homo sapiens
tgttgggacactctagtgttgt

SEQ ID NO: 556909 - DNA, 22 bp, Homo sapiens
cactgtcttccatctaagtcat

SEQ ID NO: 556910 - DNA, 22 bp, Homo sapiens
ttttgttcagtccgtcatcatt

SEQ ID NO: 556911 - DNA, 22 bp, Homo sapiens
tggagaggggagtgggggagta

SEQ ID NO: 556912 - DNA, 22 bp, Homo sapiens
aactctcctctctttctgcttt

SEQ ID NO: 556913 - DNA, 22 bp, Homo sapiens
ccaaccatccccgtgtgtctgg

SEQ ID NO: 556914 - DNA, 22 bp, Homo sapiens
ttgtctttgttcccgggactca

SEQ ID NO: 556915 - DNA, 22 bp, Homo sapiens
accttttcaagctccaagagtt

SEQ ID NO: 556916 - DNA, 22 bp, Homo sapiens
gggtcaggcttggggcccaggg

SEQ ID NO: 556917 - DNA, 22 bp, Homo sapiens
acaggatggggacagccgcccc

SEQ ID NO: 556918 - DNA, 22 bp, Homo sapiens
tgagcactgactctgtgccagg

SEQ ID NO: 556919 - DNA, 22 bp, Homo sapiens
agggttttgtgtttgctggtgc

SEQ ID NO: 556920 - DNA, 22 bp, Homo sapiens
tccagccatttctcttctgtca

SEQ ID NO: 556921 - DNA, 22 bp, Homo sapiens
tttctcttcctatagatgttgg

SEQ ID NO: 556922 - DNA, 22 bp, Homo sapiens
tcgctcgcgcactctgcggctg

SEQ ID NO: 556923 - DNA, 22 bp, Homo sapiens
gagaggaggtgcctgctgcggg

SEQ ID NO: 556924 - DNA, 22 bp, Homo sapiens
accatcagaggagaaaataatg

SEQ ID NO: 556925 - DNA, 22 bp, Homo sapiens
gccgggagttgagatgtgagca

SEQ ID NO: 556926 - DNA, 22 bp, Homo sapiens
tacattatgtatgatcaatata

SEQ ID NO: 556927 - DNA, 22 bp, Homo sapiens
tggcaggagagtgggtttgcca

SEQ ID NO: 556928 - DNA, 22 bp, Homo sapiens
aatggtggttgcttgaacttta

SEQ ID NO: 556929 - DNA, 22 bp, Homo sapiens
tctggtccctgtttggttcaac

SEQ ID NO: 556930 - DNA, 22 bp, Homo sapiens
cttttccatttctacaccctag

SEQ ID NO: 556931 - DNA, 22 bp, Homo sapiens
tttgttttgctttgcactgacc

SEQ ID NO: 556932 - DNA, 22 bp, Homo sapiens
actgtagaggcctggattgagg

SEQ ID NO: 556933 - DNA, 22 bp, Homo sapiens
ttgttctgacaatctctttggc

SEQ ID NO: 556934 - DNA, 22 bp, Homo sapiens
tggggcctgaatcactttcagt

SEQ ID NO: 556935 - DNA, 22 bp, Homo sapiens
aataatgccccaatggactgga

SEQ ID NO: 556936 - DNA, 22 bp, Homo sapiens
ttcgctgaccgcggctcagttt

SEQ ID NO: 556937 - DNA, 22 bp, Homo sapiens
tggggggctccttccacatttt

SEQ ID NO: 556938 - DNA, 22 bp, Homo sapiens
tggttttcatgcctgatgatgg

SEQ ID NO: 556939 - DNA, 22 bp, Homo sapiens
tgctcataccccatggtttctg

SEQ ID NO: 556940 - DNA, 22 bp, Homo sapiens
ccctgcccaaagctccagccct

SEQ ID NO: 556941 - DNA, 22 bp, Homo sapiens
agcatacatcagttttttccaa

SEQ ID NO: 556942 - DNA, 22 bp, Homo sapiens
tgtttcactgggatccctcaca

SEQ ID NO: 556943 - DNA, 22 bp, Homo sapiens
agtgggttttattgggaaagga

SEQ ID NO: 556944 - DNA, 22 bp, Homo sapiens
agaaggcaggggatgcagggag

SEQ ID NO: 556945 - DNA, 22 bp, Homo sapiens
tcacataggtctataagaagac

SEQ ID NO: 556946 - DNA, 22 bp, Homo sapiens
tgtatccaagcttaactaactg

SEQ ID NO: 556947 - DNA, 22 bp, Homo sapiens
ttctgtcttggggttctgatgg

SEQ ID NO: 556948 - DNA, 22 bp, Homo sapiens
aaaacaccctctaagagaggag

SEQ ID NO: 556949 - DNA, 22 bp, Homo sapiens
accattttagacctctcttgac

SEQ ID NO: 556950 - DNA, 22 bp, Homo sapiens
tagactgggaatgacttgagga

SEQ ID NO: 556951 - DNA, 22 bp, Homo sapiens
tcccaggaggtggtggaggcca

SEQ ID NO: 556952 - DNA, 22 bp, Homo sapiens
tttggctctgatcagatagagt

SEQ ID NO: 556953 - DNA, 22 bp, Homo sapiens
gcccctaaggtacagtttagta

SEQ ID NO: 556954 - DNA, 22 bp, Homo sapiens
agtcacatttcgacataactag

SEQ ID NO: 556955 - DNA, 22 bp, Homo sapiens
gctagatcacactcccagggct

SEQ ID NO: 556956 - DNA, 22 bp, Homo sapiens
gggttggccaggctgtgttctg

SEQ ID NO: 556957 - DNA, 22 bp, Homo sapiens
tcaggacttttgaaagcttaat

SEQ ID NO: 556958 - DNA, 22 bp, Homo sapiens
tgattctctttattttctgcat

SEQ ID NO: 556959 - DNA, 22 bp, Homo sapiens
gcctggaataccgagcagcgat

SEQ ID NO: 556960 - DNA, 22 bp, Homo sapiens
tgagttggaaagtaaggttgtc

SEQ ID NO: 556961 - DNA, 22 bp, Homo sapiens
ctctcttggtttcttggtgaag

SEQ ID NO: 556962 - DNA, 22 bp, Homo sapiens
tgggctgggggtggcaggcagc

SEQ ID NO: 556963 - DNA, 22 bp, Homo sapiens
tagaaaaatgaagggacttgcc

SEQ ID NO: 556964 - DNA, 22 bp, Homo sapiens
gccctgacacccctcctggggt

SEQ ID NO: 556965 - DNA, 22 bp, Homo sapiens
tctggaggagagactcaggcat

SEQ ID NO: 556966 - DNA, 22 bp, Homo sapiens
tctttctccttccttttcctat

SEQ ID NO: 556967 - DNA, 22 bp, Homo sapiens
aagtacatgttgctcaacagcc

SEQ ID NO: 556968 - DNA, 22 bp, Homo sapiens
tggggctgagacacaagtggat

SEQ ID NO: 556969 - DNA, 22 bp, Homo sapiens
ttttagataggccagtttggac

SEQ ID NO: 556970 - DNA, 22 bp, Homo sapiens
tttgaataattatctgaaataa

SEQ ID NO: 556971 - DNA, 22 bp, Homo sapiens
gttttcatcttcgtgccagagc

SEQ ID NO: 556972 - DNA, 22 bp, Homo sapiens
tgtttaaaatatgcacatggta

SEQ ID NO: 556973 - DNA, 22 bp, Homo sapiens
tgtgtttttaactctaggagtc

SEQ ID NO: 556974 - DNA, 22 bp, Homo sapiens
tggctagataggttgtcagctt

SEQ ID NO: 556975 - DNA, 22 bp, Homo sapiens
cacacggcttgccttcctctcc

SEQ ID NO: 556976 - DNA, 22 bp, Homo sapiens
tgccctggcctgtccccgcagg

SEQ ID NO: 556977 - DNA, 22 bp, Homo sapiens
agactgggaggtgtgacctatg

SEQ ID NO: 556978 - DNA, 22 bp, Homo sapiens
gtagaaatgcattactcctaga

SEQ ID NO: 556979 - DNA, 22 bp, Homo sapiens
tagacttctgcagaggctagct

SEQ ID NO: 556980 - DNA, 22 bp, Homo sapiens
tcgtatttttctgtctcttaaa

SEQ ID NO: 556981 - DNA, 22 bp, Homo sapiens
gagcatggcagctgagggcagg

SEQ ID NO: 556982 - DNA, 22 bp, Homo sapiens
cacctcttccactggagtgtaa

SEQ ID NO: 556983 - DNA, 22 bp, Homo sapiens
tgtagtttccaaaccacagaag

SEQ ID NO: 556984 - DNA, 22 bp, Homo sapiens
tggcctctggctgtcgcctccc

SEQ ID NO: 556985 - DNA, 22 bp, Homo sapiens
aaacaaactgattctaacccgt

SEQ ID NO: 556986 - DNA, 22 bp, Homo sapiens
ccacctgtcttctctatggtat

SEQ ID NO: 556987 - DNA, 22 bp, Homo sapiens
tgatctctggcctagatggaca

SEQ ID NO: 556988 - DNA, 22 bp, Homo sapiens
cagcatctgatcttggcagtgt

SEQ ID NO: 556989 - DNA, 22 bp, Homo sapiens
gatctttttggttttgtcacag

SEQ ID NO: 556990 - DNA, 22 bp, Homo sapiens
tatgaggcacccacatatagcc

SEQ ID NO: 556991 - DNA, 22 bp, Homo sapiens
tgctgccctgtttggacagccc

SEQ ID NO: 556992 - DNA, 22 bp, Homo sapiens
ggggttatgggacaaggagagc

SEQ ID NO: 556993 - DNA, 22 bp, Homo sapiens
gaaaaccaaggcctgagctggg

SEQ ID NO: 556994 - DNA, 22 bp, Homo sapiens
tggagtgggggaaggagtgtta

SEQ ID NO: 556995 - DNA, 22 bp, Homo sapiens
aagcggcccttgtgtgttggtg

SEQ ID NO: 556996 - DNA, 22 bp, Homo sapiens
gagttataacctagtttaactg

SEQ ID NO: 556997 - DNA, 22 bp, Homo sapiens
gtatttactaagtggtaaatat

SEQ ID NO: 556998 - DNA, 22 bp, Homo sapiens
tcactggggccgctatgttgag

SEQ ID NO: 556999 - DNA, 22 bp, Homo sapiens
gtcagctccagtctctggacct

SEQ ID NO: 557000 - DNA, 22 bp, Homo sapiens
cggccaaggagaaggggggtgt

SEQ ID NO: 557001 - DNA, 22 bp, Homo sapiens
cggcggcgcccggggctccgtc

SEQ ID NO: 557002 - DNA, 22 bp, Homo sapiens
aaggctggggtctgggtgttct

SEQ ID NO: 557003 - DNA, 22 bp, Homo sapiens
ataatgtcagttggtggtttag

SEQ ID NO: 557004 - DNA, 22 bp, Homo sapiens
tggttctgtgggccctggctgg

SEQ ID NO: 557005 - DNA, 22 bp, Homo sapiens
aagtgttcttctttgcctgtga

SEQ ID NO: 557006 - DNA, 22 bp, Homo sapiens
agagagaggctcagagtgggtt

SEQ ID NO: 557007 - DNA, 22 bp, Homo sapiens
ttctctcccaaatccccaaatg

SEQ ID NO: 557008 - DNA, 22 bp, Homo sapiens
tttccttagcctgctcttccct

SEQ ID NO: 557009 - DNA, 22 bp, Homo sapiens
tgtagtataatatccccccaat

SEQ ID NO: 557010 - DNA, 22 bp, Homo sapiens
caggagctgctaagtgctcctc

SEQ ID NO: 557011 - DNA, 22 bp, Homo sapiens
ttccctctgacgtggagggagg

SEQ ID NO: 557012 - DNA, 22 bp, Homo sapiens
caacatctgttctttcagaagt

SEQ ID NO: 557013 - DNA, 22 bp, Homo sapiens
ctactgagaagaatggcagaat

SEQ ID NO: 557014 - DNA, 22 bp, Homo sapiens
taccctgtggctggaagtggtc

SEQ ID NO: 557015 - DNA, 22 bp, Homo sapiens
taaatagtaatgtttgctgagc

SEQ ID NO: 557016 - DNA, 22 bp, Homo sapiens
ccaccaactaaattaaccagga

SEQ ID NO: 557017 - DNA, 22 bp, Homo sapiens
tcgaggaggaagagtgtcccag

SEQ ID NO: 557018 - DNA, 22 bp, Homo sapiens
agggaccagaatggggcctcct

SEQ ID NO: 557019 - DNA, 22 bp, Homo sapiens
ttccccaggacagtctggggta

SEQ ID NO: 557020 - DNA, 22 bp, Homo sapiens
ctgcttaaacacatgctttctg

SEQ ID NO: 557021 - DNA, 22 bp, Homo sapiens
taacctcattttcctcccttgt

SEQ ID NO: 557022 - DNA, 22 bp, Homo sapiens
tggggcaggtggaagggtgagc

SEQ ID NO: 557023 - DNA, 22 bp, Homo sapiens
gaggactgggctggtgatgagt

SEQ ID NO: 557024 - DNA, 22 bp, Homo sapiens
gctgttcaccagtcatctgcta

SEQ ID NO: 557025 - DNA, 22 bp, Homo sapiens
ataatgtggaatagtggagaac

SEQ ID NO: 557026 - DNA, 22 bp, Homo sapiens
tgcccaaggcccctgggctagc

SEQ ID NO: 557027 - DNA, 22 bp, Homo sapiens
accatcaccttccctccttatc

SEQ ID NO: 557028 - DNA, 22 bp, Homo sapiens
tcccaacactaatttattaaat

SEQ ID NO: 557029 - DNA, 22 bp, Homo sapiens
tgaagcctatctctttttaatt

SEQ ID NO: 557030 - DNA, 22 bp, Homo sapiens
tacatcaaaatgagacaagaaa

SEQ ID NO: 557031 - DNA, 22 bp, Homo sapiens
ggcctgggccaccacaggggaa

SEQ ID NO: 557032 - DNA, 22 bp, Homo sapiens
tctcttctttggacctttctga

SEQ ID NO: 557033 - DNA, 22 bp, Homo sapiens
tcatttgcttctgtgataacat

SEQ ID NO: 557034 - DNA, 22 bp, Homo sapiens
tcaccactgtgctatagctcca

SEQ ID NO: 557035 - DNA, 22 bp, Homo sapiens
actctctctcctgcttcatcag

SEQ ID NO: 557036 - DNA, 22 bp, Homo sapiens
aatgcagcccacgaatggagta

SEQ ID NO: 557037 - DNA, 22 bp, Homo sapiens
tgattataaatgctagacactc

SEQ ID NO: 557038 - DNA, 22 bp, Homo sapiens
tggacttggagtcaggaggcct

SEQ ID NO: 557039 - DNA, 22 bp, Homo sapiens
tgacatgatgagcaataatggc

SEQ ID NO: 557040 - DNA, 22 bp, Homo sapiens
tcccgggaactcatcagtctcc

SEQ ID NO: 557041 - DNA, 22 bp, Homo sapiens
tacgtgccatagagaaaagaag

SEQ ID NO: 557042 - DNA, 22 bp, Homo sapiens
tcaagtggggattgggttgcag

SEQ ID NO: 557043 - DNA, 22 bp, Homo sapiens
atggatttgctctgtgaccttg

SEQ ID NO: 557044 - DNA, 22 bp, Homo sapiens
ttggcaaagagctgctttaagc

SEQ ID NO: 557045 - DNA, 22 bp, Homo sapiens
ggcagctaatttgcacctgttc

SEQ ID NO: 557046 - DNA, 22 bp, Homo sapiens
tgccttgcctttctcctcattc

SEQ ID NO: 557047 - DNA, 22 bp, Homo sapiens
gatatgcatagatctttcttgc

SEQ ID NO: 557048 - DNA, 22 bp, Homo sapiens
tggacgctggctgtagcaacca

SEQ ID NO: 557049 - DNA, 22 bp, Homo sapiens
tatagtcagtcatacctgagtc

SEQ ID NO: 557050 - DNA, 22 bp, Homo sapiens
tagaaaatccaggtcttggaat

SEQ ID NO: 557051 - DNA, 22 bp, Homo sapiens
ataagcagctggcccccgttta

SEQ ID NO: 557052 - DNA, 22 bp, Homo sapiens
ggaggggcaagccgtgagccct

SEQ ID NO: 557053 - DNA, 22 bp, Homo sapiens
caccatatgtcatactgtagct

SEQ ID NO: 557054 - DNA, 22 bp, Homo sapiens
tgaggcaataacttggttttct

SEQ ID NO: 557055 - DNA, 22 bp, Homo sapiens
tccatttgcttattttgctgag

SEQ ID NO: 557056 - DNA, 22 bp, Homo sapiens
gttcctgggctctcatcttggt

SEQ ID NO: 557057 - DNA, 22 bp, Homo sapiens
tcctccagtgtggaaaaaaaat

SEQ ID NO: 557058 - DNA, 22 bp, Homo sapiens
ggtggccaaatctggataatac

SEQ ID NO: 557059 - DNA, 22 bp, Homo sapiens
ttctctgttttggccatgtgtg

SEQ ID NO: 557060 - DNA, 22 bp, Homo sapiens
tggggagaggggaggattgggg

SEQ ID NO: 557061 - DNA, 22 bp, Homo sapiens
ctactagactgtaaatcgcttg

SEQ ID NO: 557062 - DNA, 22 bp, Homo sapiens
aactgtccatcaggattgtgct

SEQ ID NO: 557063 - DNA, 22 bp, Homo sapiens
tcctcctcccctcttttcccca

SEQ ID NO: 557064 - DNA, 22 bp, Homo sapiens
gagccattaaaggagtggagca

SEQ ID NO: 557065 - DNA, 22 bp, Homo sapiens
tgcacatccaggctacttcctg

SEQ ID NO: 557066 - DNA, 22 bp, Homo sapiens
ttagggtcgaagccccactccc

SEQ ID NO: 557067 - DNA, 22 bp, Homo sapiens
gtatgaagggcacgttgccccc

SEQ ID NO: 557068 - DNA, 22 bp, Homo sapiens
acagtaggtgcctactaaacag

SEQ ID NO: 557069 - DNA, 22 bp, Homo sapiens
gccggaggtgccattgaccctg

SEQ ID NO: 557070 - DNA, 22 bp, Homo sapiens
tgggcagtgctgttcagaggag

SEQ ID NO: 557071 - DNA, 22 bp, Homo sapiens
gagccggaagaccagggttgaa

SEQ ID NO: 557072 - DNA, 22 bp, Homo sapiens
tggtcatagctgtagaaaacaa

SEQ ID NO: 557073 - DNA, 22 bp, Homo sapiens
gcagctcccactcactctgggc

SEQ ID NO: 557074 - DNA, 22 bp, Homo sapiens
tgggtggagggagggatcagaa

SEQ ID NO: 557075 - DNA, 22 bp, Homo sapiens
tacctggtgttttcagacccag

SEQ ID NO: 557076 - DNA, 22 bp, Homo sapiens
aacaaggtccttgagtataaag

SEQ ID NO: 557077 - DNA, 22 bp, Homo sapiens
acacttctggaagtagcagctt

SEQ ID NO: 557078 - DNA, 22 bp, Homo sapiens
ttaattcttttcatatatttca

SEQ ID NO: 557079 - DNA, 22 bp, Homo sapiens
gaagcaaggaagagctcaacaa

SEQ ID NO: 557080 - DNA, 22 bp, Homo sapiens
tcaccggcatttcaaacttaag

SEQ ID NO: 557081 - DNA, 22 bp, Homo sapiens
aactgcagatgtgaaataggct

SEQ ID NO: 557082 - DNA, 22 bp, Homo sapiens
ttttgcagaggttaaggctgag

SEQ ID NO: 557083 - DNA, 22 bp, Homo sapiens
tgccatttagctttgtgtgggt

SEQ ID NO: 557084 - DNA, 22 bp, Homo sapiens
caaggctttctcaaataggata

SEQ ID NO: 557085 - DNA, 22 bp, Homo sapiens
tggcagggggcagagttcttcc

SEQ ID NO: 557086 - DNA, 22 bp, Homo sapiens
ccttcgaggaatcgtttatttg

SEQ ID NO: 557087 - DNA, 22 bp, Homo sapiens
agatgctgcttgttcacgggca

SEQ ID NO: 557088 - DNA, 22 bp, Homo sapiens
tctgcttacacttttcattcgt

SEQ ID NO: 557089 - DNA, 22 bp, Homo sapiens
tgctgcccaccagaggacgggg

SEQ ID NO: 557090 - DNA, 22 bp, Homo sapiens
gacattgtgaaggcccacttcc

SEQ ID NO: 557091 - DNA, 22 bp, Homo sapiens
tagatgttttcttcccaggaga

SEQ ID NO: 557092 - DNA, 22 bp, Homo sapiens
tgtcctttcagggcctaacatc

SEQ ID NO: 557093 - DNA, 22 bp, Homo sapiens
gtatcagaggccctcctctatg

SEQ ID NO: 557094 - DNA, 22 bp, Homo sapiens
gatgttttcatgcatattcccc

SEQ ID NO: 557095 - DNA, 22 bp, Homo sapiens
gctgtgaccaccaagccaggtg

SEQ ID NO: 557096 - DNA, 22 bp, Homo sapiens
taggtggaagggaattttgaga

SEQ ID NO: 557097 - DNA, 22 bp, Homo sapiens
tgagtgacacaggcagagtcca

SEQ ID NO: 557098 - DNA, 22 bp, Homo sapiens
tgtgccgtgtcaaggccgggag

SEQ ID NO: 557099 - DNA, 22 bp, Homo sapiens
tgcctaggccttccccaaggct

SEQ ID NO: 557100 - DNA, 22 bp, Homo sapiens
tcgagtcttctcagaggttgga

SEQ ID NO: 557101 - DNA, 22 bp, Homo sapiens
gaggggtggaggatgggtgagg

SEQ ID NO: 557102 - DNA, 22 bp, Homo sapiens
ccacgctgggcgagctgccccc

SEQ ID NO: 557103 - DNA, 22 bp, Homo sapiens
aagtcaggtgctgagatgttcc

SEQ ID NO: 557104 - DNA, 22 bp, Homo sapiens
gccccccttccccggtgtacat

SEQ ID NO: 557105 - DNA, 22 bp, Homo sapiens
acccgggggtggagagtggagg

SEQ ID NO: 557106 - DNA, 22 bp, Homo sapiens
cacctcaggagggagggaggga

SEQ ID NO: 557107 - DNA, 22 bp, Homo sapiens
gcagggagcacagagatgaaga

SEQ ID NO: 557108 - DNA, 22 bp, Homo sapiens
cagcaagtcacctcacagccct

SEQ ID NO: 557109 - DNA, 22 bp, Homo sapiens
tgagacgtgtatctcatttttt

SEQ ID NO: 557110 - DNA, 22 bp, Homo sapiens
gaaagaggtgacatgaacaacc

SEQ ID NO: 557111 - DNA, 22 bp, Homo sapiens
tcctgggaatgaggcccgcttc

SEQ ID NO: 557112 - DNA, 22 bp, Homo sapiens
tgaaacctggatattttagggt

SEQ ID NO: 557113 - DNA, 22 bp, Homo sapiens
acacttagatctattaggtgct

SEQ ID NO: 557114 - DNA, 22 bp, Homo sapiens
cctatgatttatgttaccccca

SEQ ID NO: 557115 - DNA, 22 bp, Homo sapiens
atggacttggactctggctctg

SEQ ID NO: 557116 - DNA, 22 bp, Homo sapiens
tctctctcccacctcctgtaat

SEQ ID NO: 557117 - DNA, 22 bp, Homo sapiens
tttgttttgctcttatatggtg

SEQ ID NO: 557118 - DNA, 22 bp, Homo sapiens
gtctcagaccttaaaatgtcaa

SEQ ID NO: 557119 - DNA, 22 bp, Homo sapiens
aggtgagctctccgagagtggt

SEQ ID NO: 557120 - DNA, 22 bp, Homo sapiens
aggaagcagagcaaagtcctgg

SEQ ID NO: 557121 - DNA, 22 bp, Homo sapiens
ccttgggctgcggtttaagaca

SEQ ID NO: 557122 - DNA, 22 bp, Homo sapiens
tgcgtgccccggccacccccgg

SEQ ID NO: 557123 - DNA, 22 bp, Homo sapiens
gaatcctaagaggctgctggga

SEQ ID NO: 557124 - DNA, 22 bp, Homo sapiens
tgcttagatttgatcctttggc

SEQ ID NO: 557125 - DNA, 22 bp, Homo sapiens
actgccaaggcacatcattgct

SEQ ID NO: 557126 - DNA, 22 bp, Homo sapiens
tggccaagggtcaggcccctag

SEQ ID NO: 557127 - DNA, 22 bp, Homo sapiens
ggaggagcggcagatggagtgg

SEQ ID NO: 557128 - DNA, 22 bp, Homo sapiens
gtgggggtctctgagcaggtaa

SEQ ID NO: 557129 - DNA, 22 bp, Homo sapiens
aaattgctgttgtgccgcagtc

SEQ ID NO: 557130 - DNA, 22 bp, Homo sapiens
tgttctaacacaaattcacctg

SEQ ID NO: 557131 - DNA, 22 bp, Homo sapiens
catattcaccactggacaaatc

SEQ ID NO: 557132 - DNA, 22 bp, Homo sapiens
tttctagggcacagacagtgca

SEQ ID NO: 557133 - DNA, 22 bp, Homo sapiens
tgagttagcccgtttcaataga

SEQ ID NO: 557134 - DNA, 22 bp, Homo sapiens
tttcaggtaaacaatgattgag

SEQ ID NO: 557135 - DNA, 22 bp, Homo sapiens
tgagttttggtttcttggagtt

SEQ ID NO: 557136 - DNA, 22 bp, Homo sapiens
tttcacttattgactccctgtc

SEQ ID NO: 557137 - DNA, 22 bp, Homo sapiens
aggcttcaggctccctgaggaa

SEQ ID NO: 557138 - DNA, 22 bp, Homo sapiens
gataattcttcaatgtgggaca

SEQ ID NO: 557139 - DNA, 22 bp, Homo sapiens
taggagactggtagactctaac

SEQ ID NO: 557140 - DNA, 22 bp, Homo sapiens
cagaagaatgcggactgaagaa

SEQ ID NO: 557141 - DNA, 22 bp, Homo sapiens
taggcagctcacgtgtaggggc

SEQ ID NO: 557142 - DNA, 22 bp, Homo sapiens
taggtaaactgccaaatctcat

SEQ ID NO: 557143 - DNA, 22 bp, Homo sapiens
tcaggacagtaggctcacctga

SEQ ID NO: 557144 - DNA, 22 bp, Homo sapiens
tggcaagcaattttcttatgca

SEQ ID NO: 557145 - DNA, 22 bp, Homo sapiens
ttagacctcattacctagccag

SEQ ID NO: 557146 - DNA, 22 bp, Homo sapiens
tgttgaatctgagggccaggct

SEQ ID NO: 557147 - DNA, 22 bp, Homo sapiens
ttcatggaatgttaaataatgc

SEQ ID NO: 557148 - DNA, 22 bp, Homo sapiens
acctgcaatagggtccacaggg

SEQ ID NO: 557149 - DNA, 22 bp, Homo sapiens
tggatgcctgtgacatctgagt

SEQ ID NO: 557150 - DNA, 22 bp, Homo sapiens
ctttctgtcatggcctggggca

SEQ ID NO: 557151 - DNA, 22 bp, Homo sapiens
cctggccaggccccttgcaggg

SEQ ID NO: 557152 - DNA, 22 bp, Homo sapiens
ctgactcaggctggtgctttct

SEQ ID NO: 557153 - DNA, 22 bp, Homo sapiens
agcaacaattaagaagctgcag

SEQ ID NO: 557154 - DNA, 22 bp, Homo sapiens
gccggcccctcccccacttccg

SEQ ID NO: 557155 - DNA, 22 bp, Homo sapiens
ctttggtgacaggcatgtgtgg

SEQ ID NO: 557156 - DNA, 22 bp, Homo sapiens
gatgccaggaaataactttcat

SEQ ID NO: 557157 - DNA, 22 bp, Homo sapiens
cataggcttgctctaacaatgc

SEQ ID NO: 557158 - DNA, 22 bp, Homo sapiens
aggctctggatgcaaaggaccc

SEQ ID NO: 557159 - DNA, 22 bp, Homo sapiens
gctctaggcttcaggggtctgt

SEQ ID NO: 557160 - DNA, 22 bp, Homo sapiens
taagtgccttgattttgcagct

SEQ ID NO: 557161 - DNA, 22 bp, Homo sapiens
agagttttatatgcagttgcca

SEQ ID NO: 557162 - DNA, 22 bp, Homo sapiens
tctgtcagcctcactggtagca

SEQ ID NO: 557163 - DNA, 22 bp, Homo sapiens
aaagcataagtggatgaacaaa

SEQ ID NO: 557164 - DNA, 22 bp, Homo sapiens
tgcgcctcctgctcgtggtgtg

SEQ ID NO: 557165 - DNA, 22 bp, Homo sapiens
tgtcccggctctatccccagct

SEQ ID NO: 557166 - DNA, 22 bp, Homo sapiens
cctgagcttggggctatttctg

SEQ ID NO: 557167 - DNA, 22 bp, Homo sapiens
cctggtttgggaatggttccat

SEQ ID NO: 557168 - DNA, 22 bp, Homo sapiens
tggggagggctgagccaagtac

SEQ ID NO: 557169 - DNA, 22 bp, Homo sapiens
tggttgcttgatgagattagag

SEQ ID NO: 557170 - DNA, 22 bp, Homo sapiens
caactcatgtgcagctcatggc

SEQ ID NO: 557171 - DNA, 22 bp, Homo sapiens
ctaggagaaagaaagagctggc

SEQ ID NO: 557172 - DNA, 22 bp, Homo sapiens
cctcagagcttgggttttctta

SEQ ID NO: 557173 - DNA, 22 bp, Homo sapiens
cgcccgatgaagaagatcccag

SEQ ID NO: 557174 - DNA, 22 bp, Homo sapiens
tcaggctcccctcagattccac

SEQ ID NO: 557175 - DNA, 22 bp, Homo sapiens
cgcagccgcctgggtcttcccc

SEQ ID NO: 557176 - DNA, 22 bp, Homo sapiens
gtctttgtgttttgaggagggg

SEQ ID NO: 557177 - DNA, 22 bp, Homo sapiens
tttgccttcccagggatccacc

SEQ ID NO: 557178 - DNA, 22 bp, Homo sapiens
ttagctcttggagttgctgaaa

SEQ ID NO: 557179 - DNA, 22 bp, Homo sapiens
gaaaaggaaaatgaggtaagga

SEQ ID NO: 557180 - DNA, 22 bp, Homo sapiens
tattaatatatgcctcgagtgg

SEQ ID NO: 557181 - DNA, 22 bp, Homo sapiens
ggctgaggagcacagagaggga

SEQ ID NO: 557182 - DNA, 22 bp, Homo sapiens
aagagacaaacatgaaaacctc

SEQ ID NO: 557183 - DNA, 22 bp, Homo sapiens
ttggggaatgatggggtggaac

SEQ ID NO: 557184 - DNA, 22 bp, Homo sapiens
cagcgtgcgcgtgagccccttg

SEQ ID NO: 557185 - DNA, 22 bp, Homo sapiens
ataaaggtgttggaacaatcgt

SEQ ID NO: 557186 - DNA, 22 bp, Homo sapiens
tgaagcccgttattgttcatta

SEQ ID NO: 557187 - DNA, 22 bp, Homo sapiens
tcctctcaaggaggctgctatc

SEQ ID NO: 557188 - DNA, 22 bp, Homo sapiens
tatttctttcttgcttgctctc

SEQ ID NO: 557189 - DNA, 22 bp, Homo sapiens
tagtactgttggcatggaggtg

SEQ ID NO: 557190 - DNA, 22 bp, Homo sapiens
taatacctgctctacagctggg

SEQ ID NO: 557191 - DNA, 22 bp, Homo sapiens
caggacaagcttttgccattgc

SEQ ID NO: 557192 - DNA, 22 bp, Homo sapiens
tattgggagaaatgagtgctat

SEQ ID NO: 557193 - DNA, 22 bp, Homo sapiens
aagcttacaaaagacatgattt

SEQ ID NO: 557194 - DNA, 22 bp, Homo sapiens
tttaactcttcttgttttcact

SEQ ID NO: 557195 - DNA, 22 bp, Homo sapiens
tctctgtcatgtgagtggtccc

SEQ ID NO: 557196 - DNA, 22 bp, Homo sapiens
tgcaaacaaccactgattaacc

SEQ ID NO: 557197 - DNA, 22 bp, Homo sapiens
tgggagggggaaccgtgggccc

SEQ ID NO: 557198 - DNA, 22 bp, Homo sapiens
tgagagcagcaaacaaagttgt

SEQ ID NO: 557199 - DNA, 22 bp, Homo sapiens
agcagtgcagtgagctgattca

SEQ ID NO: 557200 - DNA, 22 bp, Homo sapiens
ttcagtgattccgattccaaac

SEQ ID NO: 557201 - DNA, 22 bp, Homo sapiens
ctctcgctagcgctctgcgccc

SEQ ID NO: 557202 - DNA, 22 bp, Homo sapiens
ctcagctgtgagttcttccttg

SEQ ID NO: 557203 - DNA, 22 bp, Homo sapiens
tgccttcctcttcactccctcc

SEQ ID NO: 557204 - DNA, 22 bp, Homo sapiens
agagccatatccttgaggctgc

SEQ ID NO: 557205 - DNA, 22 bp, Homo sapiens
atggggggctggtgctccgacg

SEQ ID NO: 557206 - DNA, 22 bp, Homo sapiens
acctggtttcatttccagcaca

SEQ ID NO: 557207 - DNA, 22 bp, Homo sapiens
tgctttcaatctcctcccagtg

SEQ ID NO: 557208 - DNA, 22 bp, Homo sapiens
tgcggtaggtggttattttgtt

SEQ ID NO: 557209 - DNA, 22 bp, Homo sapiens
ggcttcagactccttggggctc

SEQ ID NO: 557210 - DNA, 22 bp, Homo sapiens
agattgccaggcccaccctctt

SEQ ID NO: 557211 - DNA, 22 bp, Homo sapiens
agagtcaattttctgttacata

SEQ ID NO: 557212 - DNA, 22 bp, Homo sapiens
cccagctgttctttctgttttt

SEQ ID NO: 557213 - DNA, 22 bp, Homo sapiens
tttttgcccacctgggagtcaa

SEQ ID NO: 557214 - DNA, 22 bp, Homo sapiens
agctggggctggaggggggcca

SEQ ID NO: 557215 - DNA, 22 bp, Homo sapiens
ttctgccctcaattatgcacat

SEQ ID NO: 557216 - DNA, 22 bp, Homo sapiens
gtatgcaataaaaaacttccag

SEQ ID NO: 557217 - DNA, 22 bp, Homo sapiens
actggaagtctttggaagtggg

SEQ ID NO: 557218 - DNA, 22 bp, Homo sapiens
gggctctgacgttcggacagca

SEQ ID NO: 557219 - DNA, 22 bp, Homo sapiens
tttgttactgatggtaagtaaa

SEQ ID NO: 557220 - DNA, 22 bp, Homo sapiens
tgtgctaggtacactggtcttt

SEQ ID NO: 557221 - DNA, 22 bp, Homo sapiens
tgagtttgtttaggactggtgt

SEQ ID NO: 557222 - DNA, 22 bp, Homo sapiens
tcagggctctgccacaggggct

SEQ ID NO: 557223 - DNA, 22 bp, Homo sapiens
tctttctgatgtagattgagaa

SEQ ID NO: 557224 - DNA, 22 bp, Homo sapiens
tttgacaggatggatggactga

SEQ ID NO: 557225 - DNA, 22 bp, Homo sapiens
aatggatttgtaggaggaaggg

SEQ ID NO: 557226 - DNA, 22 bp, Homo sapiens
ccacagagagagaagtaagtga

SEQ ID NO: 557227 - DNA, 22 bp, Homo sapiens
gggtaggggttgggggtggctg

SEQ ID NO: 557228 - DNA, 22 bp, Homo sapiens
aggtcttggaagaagttgcacc

SEQ ID NO: 557229 - DNA, 22 bp, Homo sapiens
aacattgcttccagggatcctg

SEQ ID NO: 557230 - DNA, 22 bp, Homo sapiens
tatagactacttttctttctac

SEQ ID NO: 557231 - DNA, 22 bp, Homo sapiens
tttccagagtcacccctaactc

SEQ ID NO: 557232 - DNA, 22 bp, Homo sapiens
tagaggaaaatgaaactagcat

SEQ ID NO: 557233 - DNA, 22 bp, Homo sapiens
tgctacaaatagcttagcatct

SEQ ID NO: 557234 - DNA, 22 bp, Homo sapiens
atttaacattatgattggggat

SEQ ID NO: 557235 - DNA, 22 bp, Homo sapiens
tgggagataatgaattgttgga

SEQ ID NO: 557236 - DNA, 22 bp, Homo sapiens
atgggggaaggagagcctgtgt

SEQ ID NO: 557237 - DNA, 22 bp, Homo sapiens
tgaagttctaggagctagtctt

SEQ ID NO: 557238 - DNA, 22 bp, Homo sapiens
tgggagtgatcaacatatactg

SEQ ID NO: 557239 - DNA, 22 bp, Homo sapiens
tggctggctcggaagggactgc

SEQ ID NO: 557240 - DNA, 22 bp, Homo sapiens
agactgaagatggctctattgg

SEQ ID NO: 557241 - DNA, 22 bp, Homo sapiens
tgagtgccgggcgtggagagct

SEQ ID NO: 557242 - DNA, 22 bp, Homo sapiens
tgtgttagtgtggatggtgtta

SEQ ID NO: 557243 - DNA, 22 bp, Homo sapiens
tcctgccccatgagctgtgaaa

SEQ ID NO: 557244 - DNA, 22 bp, Homo sapiens
gagttgtttgggttggggatca

SEQ ID NO: 557245 - DNA, 22 bp, Homo sapiens
agggttcatgaaattataggag

SEQ ID NO: 557246 - DNA, 22 bp, Homo sapiens
tccctctcctgcttcatcccca

SEQ ID NO: 557247 - DNA, 22 bp, Homo sapiens
tcctgagctgagctgcggggaa

SEQ ID NO: 557248 - DNA, 22 bp, Homo sapiens
gtttctgggtatgcagggttta

SEQ ID NO: 557249 - DNA, 22 bp, Homo sapiens
aaactgtcattggatgcatttg

SEQ ID NO: 557250 - DNA, 22 bp, Homo sapiens
cagtgatgtagaataaagcagg

SEQ ID NO: 557251 - DNA, 22 bp, Homo sapiens
accctttccccgcagacctctc

SEQ ID NO: 557252 - DNA, 22 bp, Homo sapiens
tatgtaagaaaatagtcaacca

SEQ ID NO: 557253 - DNA, 22 bp, Homo sapiens
aggcttccttgggaacaacagg

SEQ ID NO: 557254 - DNA, 22 bp, Homo sapiens
tctggtcctcccaaaaagaagc

SEQ ID NO: 557255 - DNA, 22 bp, Homo sapiens
cctcccgagccccaattccctt

SEQ ID NO: 557256 - DNA, 22 bp, Homo sapiens
tgggggttctggatccaggtgc

SEQ ID NO: 557257 - DNA, 22 bp, Homo sapiens
tggggggcggggaggtgacggg

SEQ ID NO: 557258 - DNA, 22 bp, Homo sapiens
tgctcattcaagtgaagagtca

SEQ ID NO: 557259 - DNA, 22 bp, Homo sapiens
agaagaagggtgaatggcccag

SEQ ID NO: 557260 - DNA, 22 bp, Homo sapiens
agcagcttccccaaagtgcctt

SEQ ID NO: 557261 - DNA, 22 bp, Homo sapiens
actccacgccttttgtctgctg

SEQ ID NO: 557262 - DNA, 22 bp, Homo sapiens
tggtccagtggggatctctgat

SEQ ID NO: 557263 - DNA, 22 bp, Homo sapiens
cccagatacaatggacaatatg

SEQ ID NO: 557264 - DNA, 22 bp, Homo sapiens
tcataatggctcatttctgccc

SEQ ID NO: 557265 - DNA, 22 bp, Homo sapiens
ggcgtcactcccagttgcttgg

SEQ ID NO: 557266 - DNA, 22 bp, Homo sapiens
agtagataagtcaaggtctgaa

SEQ ID NO: 557267 - DNA, 22 bp, Homo sapiens
ggtggtttccttttgtctcctt

SEQ ID NO: 557268 - DNA, 22 bp, Homo sapiens
tacctgctcacactgttactcc

SEQ ID NO: 557269 - DNA, 22 bp, Homo sapiens
ggtcaggagagggggcaggcac

SEQ ID NO: 557270 - DNA, 22 bp, Homo sapiens
gggattagggtctgggctggaa

SEQ ID NO: 557271 - DNA, 22 bp, Homo sapiens
tctgagatccagaggatggcta

SEQ ID NO: 557272 - DNA, 22 bp, Homo sapiens
tcatttcaatgatactactaag

SEQ ID NO: 557273 - DNA, 22 bp, Homo sapiens
cagcatggccatcctgggcttc

SEQ ID NO: 557274 - DNA, 22 bp, Homo sapiens
ttggttttcagcttcactggat

SEQ ID NO: 557275 - DNA, 22 bp, Homo sapiens
tacacagcaggggtcaagggta

SEQ ID NO: 557276 - DNA, 22 bp, Homo sapiens
agggagcagcatccttcacttg

SEQ ID NO: 557277 - DNA, 22 bp, Homo sapiens
gccccgggatggaggggaagta

SEQ ID NO: 557278 - DNA, 22 bp, Homo sapiens
tggcatatacttagtgcatgct

SEQ ID NO: 557279 - DNA, 22 bp, Homo sapiens
tatgtacccactcatattcccc

SEQ ID NO: 557280 - DNA, 22 bp, Homo sapiens
agcccctcccctttctccgccc

SEQ ID NO: 557281 - DNA, 22 bp, Homo sapiens
ttgacctctttggctcctggct

SEQ ID NO: 557282 - DNA, 22 bp, Homo sapiens
ggagaaaggtatcatctgctgt

SEQ ID NO: 557283 - DNA, 22 bp, Homo sapiens
tctataagttttaagtcaggca

SEQ ID NO: 557284 - DNA, 22 bp, Homo sapiens
ggtgagccattctatttagatt

SEQ ID NO: 557285 - DNA, 22 bp, Homo sapiens
tactattagcacaattgtaata

SEQ ID NO: 557286 - DNA, 22 bp, Homo sapiens
tctctgttccatttttcttgcc

SEQ ID NO: 557287 - DNA, 22 bp, Homo sapiens
ctgtccagcttagcatataggg

SEQ ID NO: 557288 - DNA, 22 bp, Homo sapiens
tgctgttgtgctgtactctaca

SEQ ID NO: 557289 - DNA, 22 bp, Homo sapiens
tgtgctgcgcagatgtgcctgc

SEQ ID NO: 557290 - DNA, 22 bp, Homo sapiens
tgttacataaaagaatgtctct

SEQ ID NO: 557291 - DNA, 22 bp, Homo sapiens
tgtagtgtgcttcttgtctgaa

SEQ ID NO: 557292 - DNA, 22 bp, Homo sapiens
agtggcttggctgcactacagg

SEQ ID NO: 557293 - DNA, 22 bp, Homo sapiens
aaactgtgcctctgcagtccta

SEQ ID NO: 557294 - DNA, 22 bp, Homo sapiens
tgtgtgtatgtgtatatattga

SEQ ID NO: 557295 - DNA, 22 bp, Homo sapiens
ggtagtcactggggatgtaagc

SEQ ID NO: 557296 - DNA, 22 bp, Homo sapiens
gccagtacctgctcatcagggt

SEQ ID NO: 557297 - DNA, 22 bp, Homo sapiens
tcacccttccttctacagagca

SEQ ID NO: 557298 - DNA, 22 bp, Homo sapiens
tatggcatttccttgtgcatct

SEQ ID NO: 557299 - DNA, 22 bp, Homo sapiens
cgaagcccccggcccggcggcg

SEQ ID NO: 557300 - DNA, 22 bp, Homo sapiens
tgagcccacttggacagaggtc

SEQ ID NO: 557301 - DNA, 22 bp, Homo sapiens
tcctcgaaaggccctggggcag

SEQ ID NO: 557302 - DNA, 22 bp, Homo sapiens
gtcattatggttcagtgaagca

SEQ ID NO: 557303 - DNA, 22 bp, Homo sapiens
tccaaacgtgctgtttccacat

SEQ ID NO: 557304 - DNA, 22 bp, Homo sapiens
tctagaacggttaggcttctgt

SEQ ID NO: 557305 - DNA, 22 bp, Homo sapiens
tagctgtttatgcactcctgcc

SEQ ID NO: 557306 - DNA, 22 bp, Homo sapiens
agtgcctgttggccaaagctca

SEQ ID NO: 557307 - DNA, 22 bp, Homo sapiens
tcggagaggaaaaaccattgat

SEQ ID NO: 557308 - DNA, 22 bp, Homo sapiens
tcactttgaaaatagactgttt

SEQ ID NO: 557309 - DNA, 22 bp, Homo sapiens
ttttaggcaggtgtgatattag

SEQ ID NO: 557310 - DNA, 22 bp, Homo sapiens
agggacaggaggagcgccaggc

SEQ ID NO: 557311 - DNA, 22 bp, Homo sapiens
tcagtcttcttggaggcttctt

SEQ ID NO: 557312 - DNA, 22 bp, Homo sapiens
cccagagtacagcatagtactc

SEQ ID NO: 557313 - DNA, 22 bp, Homo sapiens
tgaggattaatgatcaactgga

SEQ ID NO: 557314 - DNA, 22 bp, Homo sapiens
tggtgcggcaggtttttcatgc

SEQ ID NO: 557315 - DNA, 22 bp, Homo sapiens
atgggagtgcttgaggatgaaa

SEQ ID NO: 557316 - DNA, 22 bp, Homo sapiens
atgccctggttctgccttttgt

SEQ ID NO: 557317 - DNA, 22 bp, Homo sapiens
catctataaggaccccatgcag

SEQ ID NO: 557318 - DNA, 22 bp, Homo sapiens
atatgccatgttggtgtgctgc

SEQ ID NO: 557319 - DNA, 22 bp, Homo sapiens
agggcctgttttcccggtggct

SEQ ID NO: 557320 - DNA, 22 bp, Homo sapiens
taatcatgagctggtaggtcat

SEQ ID NO: 557321 - DNA, 22 bp, Homo sapiens
ggtgctgctagtttgaaagggc

SEQ ID NO: 557322 - DNA, 22 bp, Homo sapiens
tcctccttcactgtagcatgtg

SEQ ID NO: 557323 - DNA, 22 bp, Homo sapiens
gctgtcctagagacatcagatg

SEQ ID NO: 557324 - DNA, 22 bp, Homo sapiens
ttctatggaaactaaaagccta

SEQ ID NO: 557325 - DNA, 22 bp, Homo sapiens
acttttttggtagtgccttctg

SEQ ID NO: 557326 - DNA, 22 bp, Homo sapiens
ttcggctgtccagatgtatcca

SEQ ID NO: 557327 - DNA, 22 bp, Homo sapiens
gcctgcaggtccagctgttgca

SEQ ID NO: 557328 - DNA, 22 bp, Homo sapiens
tcttctcccctccctcccagat

SEQ ID NO: 557329 - DNA, 22 bp, Homo sapiens
ccagacatcagtgcccgtggca

SEQ ID NO: 557330 - DNA, 22 bp, Homo sapiens
gctctgggaattgccagatatc

SEQ ID NO: 557331 - DNA, 22 bp, Homo sapiens
aatcagcctcctgtaccactcc

SEQ ID NO: 557332 - DNA, 22 bp, Homo sapiens
cccctgcccgcgctggccgcct

SEQ ID NO: 557333 - DNA, 22 bp, Homo sapiens
ccttccgcagccatcgagttga

SEQ ID NO: 557334 - DNA, 22 bp, Homo sapiens
ggtgaggtggcaacatggtcat

SEQ ID NO: 557335 - DNA, 22 bp, Homo sapiens
cctttctcaggctgatgtgtgc

SEQ ID NO: 557336 - DNA, 22 bp, Homo sapiens
tgtcttttcactggtgccttct

SEQ ID NO: 557337 - DNA, 22 bp, Homo sapiens
tgggatgggggttgagaaggag

SEQ ID NO: 557338 - DNA, 22 bp, Homo sapiens
ccctgactggctccagtgttat

SEQ ID NO: 557339 - DNA, 22 bp, Homo sapiens
tctggttctaaatgctccagtg

SEQ ID NO: 557340 - DNA, 22 bp, Homo sapiens
gagacagagggtgcaggaaaga

SEQ ID NO: 557341 - DNA, 22 bp, Homo sapiens
tctaagactcctcacattttct

SEQ ID NO: 557342 - DNA, 22 bp, Homo sapiens
gtcacgcggagagatggctttg

SEQ ID NO: 557343 - DNA, 22 bp, Homo sapiens
tccttacccatctgtgaggtgc

SEQ ID NO: 557344 - DNA, 22 bp, Homo sapiens
gccctggggaagggggagggaa

SEQ ID NO: 557345 - DNA, 22 bp, Homo sapiens
tttgctgtagagattctcagtt

SEQ ID NO: 557346 - DNA, 22 bp, Homo sapiens
tgcacagctggaatgtggccac

SEQ ID NO: 557347 - DNA, 22 bp, Homo sapiens
ctgctggactctgaagtctgtg

SEQ ID NO: 557348 - DNA, 22 bp, Homo sapiens
caagcccctctgtctggaatag

SEQ ID NO: 557349 - DNA, 22 bp, Homo sapiens
tgtttttctggtgctttttaca

SEQ ID NO: 557350 - DNA, 22 bp, Homo sapiens
tgggagtccctgagggaattat

SEQ ID NO: 557351 - DNA, 22 bp, Homo sapiens
tggatggggaggggcccaggct

SEQ ID NO: 557352 - DNA, 22 bp, Homo sapiens
taaccccctggaaggggtccca

SEQ ID NO: 557353 - DNA, 22 bp, Homo sapiens
caaacacaggtgtctttctgac

SEQ ID NO: 557354 - DNA, 22 bp, Homo sapiens
ccctaaccagatgttctgatta

SEQ ID NO: 557355 - DNA, 22 bp, Homo sapiens
agtgccttttccctactgcctc

SEQ ID NO: 557356 - DNA, 22 bp, Homo sapiens
taatctgtttcccagctgagac

SEQ ID NO: 557357 - DNA, 22 bp, Homo sapiens
ttatttgtttacctgattattg

SEQ ID NO: 557358 - DNA, 22 bp, Homo sapiens
tatgcaacagggaaggctatgt

SEQ ID NO: 557359 - DNA, 22 bp, Homo sapiens
actggtagctttttattgactg

SEQ ID NO: 557360 - DNA, 22 bp, Homo sapiens
taaaggtgttggaacaatcgtg

SEQ ID NO: 557361 - DNA, 22 bp, Homo sapiens
aggaaggcgaagggccttctgg

SEQ ID NO: 557362 - DNA, 22 bp, Homo sapiens
tggggttgaactctagtcagta

SEQ ID NO: 557363 - DNA, 22 bp, Homo sapiens
taatgggattactagcatggga

SEQ ID NO: 557364 - DNA, 22 bp, Homo sapiens
ggtaaatattggtttagcctgg

SEQ ID NO: 557365 - DNA, 22 bp, Homo sapiens
tgggctggggttgatgagaagg

SEQ ID NO: 557366 - DNA, 22 bp, Homo sapiens
tgggggtcccgccaagcctcac

SEQ ID NO: 557367 - DNA, 22 bp, Homo sapiens
tgtctggatatcttggaattag

SEQ ID NO: 557368 - DNA, 22 bp, Homo sapiens
agtggctgggtttggacggcaa

SEQ ID NO: 557369 - DNA, 22 bp, Homo sapiens
ttccttttcttaacacctccat

SEQ ID NO: 557370 - DNA, 22 bp, Homo sapiens
tgacatggctgccgcaggcagg

SEQ ID NO: 557371 - DNA, 22 bp, Homo sapiens
ggggatgccctctatctgcaat

SEQ ID NO: 557372 - DNA, 22 bp, Homo sapiens
ctgggccaccatgacctacccg

SEQ ID NO: 557373 - DNA, 22 bp, Homo sapiens
tggactagacaacttatcagaa

SEQ ID NO: 557374 - DNA, 22 bp, Homo sapiens
ccagacagcaaatcagttgtag

SEQ ID NO: 557375 - DNA, 22 bp, Homo sapiens
tcaggaagtcttaacaattggc

SEQ ID NO: 557376 - DNA, 22 bp, Homo sapiens
tccccaaagctgtcatattaag

SEQ ID NO: 557377 - DNA, 22 bp, Homo sapiens
ttcgtcatcctcctgaggcctg

SEQ ID NO: 557378 - DNA, 22 bp, Homo sapiens
tgaccagggaatttttatgtag

SEQ ID NO: 557379 - DNA, 22 bp, Homo sapiens
acgttgaggttcttctgaggtg

SEQ ID NO: 557380 - DNA, 22 bp, Homo sapiens
tgtccaattctagattacactg

SEQ ID NO: 557381 - DNA, 22 bp, Homo sapiens
agagcagggtccctgttgtttc

SEQ ID NO: 557382 - DNA, 22 bp, Homo sapiens
tttttattcctttttctttgtg

SEQ ID NO: 557383 - DNA, 22 bp, Homo sapiens
acaggcagttggaggttgtagc

SEQ ID NO: 557384 - DNA, 22 bp, Homo sapiens
ccggttctcccaagcccagctc

SEQ ID NO: 557385 - DNA, 22 bp, Homo sapiens
ttgaatttgtcaaatgtcacac

SEQ ID NO: 557386 - DNA, 22 bp, Homo sapiens
ccctgtgctgtgtcctggggta

SEQ ID NO: 557387 - DNA, 22 bp, Homo sapiens
tgggctcagggcaggggaaatg

SEQ ID NO: 557388 - DNA, 22 bp, Homo sapiens
cacagagcactgcttgtaagga

SEQ ID NO: 557389 - DNA, 22 bp, Homo sapiens
tataaactatcttgttacacgg

SEQ ID NO: 557390 - DNA, 22 bp, Homo sapiens
gactacaactcccaaggtacat

SEQ ID NO: 557391 - DNA, 22 bp, Homo sapiens
ccttcctccacccacaactagt

SEQ ID NO: 557392 - DNA, 22 bp, Homo sapiens
tgggcagtggaatttgagtgat

SEQ ID NO: 557393 - DNA, 22 bp, Homo sapiens
gaggaggtgaagattttggggg

SEQ ID NO: 557394 - DNA, 22 bp, Homo sapiens
tcagggagccacgtgatcctga

SEQ ID NO: 557395 - DNA, 22 bp, Homo sapiens
tccttctgttctagttagctgt

SEQ ID NO: 557396 - DNA, 22 bp, Homo sapiens
tctccaatccggtcagagccgt

SEQ ID NO: 557397 - DNA, 22 bp, Homo sapiens
gagttaatcctagcaaaaatag

SEQ ID NO: 557398 - DNA, 22 bp, Homo sapiens
tgtagaattgatttcccagtct

SEQ ID NO: 557399 - DNA, 22 bp, Homo sapiens
ttaagtttaatttaaagaaaac

SEQ ID NO: 557400 - DNA, 22 bp, Homo sapiens
taaaggatatagaaggttttcc

SEQ ID NO: 557401 - DNA, 22 bp, Homo sapiens
gagggaatttgcaggttgtttt

SEQ ID NO: 557402 - DNA, 22 bp, Homo sapiens
ttactggttttatttttttcct

SEQ ID NO: 557403 - DNA, 22 bp, Homo sapiens
ccgtgttcagctcctccccgag

SEQ ID NO: 557404 - DNA, 22 bp, Homo sapiens
atcctcccacccctgtgccctg

SEQ ID NO: 557405 - DNA, 22 bp, Homo sapiens
tgcggtttcctatgtgggccaa

SEQ ID NO: 557406 - DNA, 22 bp, Homo sapiens
tgcatacagtgggtctttgtgt

SEQ ID NO: 557407 - DNA, 22 bp, Homo sapiens
cattggctcttggcctgtttgg

SEQ ID NO: 557408 - DNA, 22 bp, Homo sapiens
ggggccagcctcatcccactgc

SEQ ID NO: 557409 - DNA, 22 bp, Homo sapiens
tacactgtagtatgatttttcc

SEQ ID NO: 557410 - DNA, 22 bp, Homo sapiens
tctcacctgacataagcaactc

SEQ ID NO: 557411 - DNA, 22 bp, Homo sapiens
tttcaggcctcagtttcctcct

SEQ ID NO: 557412 - DNA, 22 bp, Homo sapiens
tccagcttaatggcatgtttcc

SEQ ID NO: 557413 - DNA, 22 bp, Homo sapiens
tcaagcccggtgttcagacttc

SEQ ID NO: 557414 - DNA, 22 bp, Homo sapiens
tcctctaattttcctaagcaca

SEQ ID NO: 557415 - DNA, 22 bp, Homo sapiens
tacacaggtttatctctctgac

SEQ ID NO: 557416 - DNA, 22 bp, Homo sapiens
tgcaatgaacatctttttacat

SEQ ID NO: 557417 - DNA, 22 bp, Homo sapiens
ttaaacagccagtgcaaacatt

SEQ ID NO: 557418 - DNA, 22 bp, Homo sapiens
aacacttcacaggataatgctt

SEQ ID NO: 557419 - DNA, 22 bp, Homo sapiens
tctgcttccgctcccccctcca

SEQ ID NO: 557420 - DNA, 22 bp, Homo sapiens
tcaggtgacaatgtcaggagct

SEQ ID NO: 557421 - DNA, 22 bp, Homo sapiens
ttccagacagaggggcttgtag

SEQ ID NO: 557422 - DNA, 22 bp, Homo sapiens
gcagagacatgtgcctatgggg

SEQ ID NO: 557423 - DNA, 22 bp, Homo sapiens
caacacttgaccacatcctgag

SEQ ID NO: 557424 - DNA, 22 bp, Homo sapiens
gggctgccgccgctggtgtccg

SEQ ID NO: 557425 - DNA, 22 bp, Homo sapiens
ttcttgtcagcacttggtaggg

SEQ ID NO: 557426 - DNA, 22 bp, Homo sapiens
agttcattcctttggagaaaag

SEQ ID NO: 557427 - DNA, 22 bp, Homo sapiens
gtcatacacggctctcctctct

SEQ ID NO: 557428 - DNA, 22 bp, Homo sapiens
ttgcttttatgattatttccat

SEQ ID NO: 557429 - DNA, 22 bp, Homo sapiens
tccagttcatcagatcaggttg

SEQ ID NO: 557430 - DNA, 22 bp, Homo sapiens
tgctgcatttgcagtcctttaa

SEQ ID NO: 557431 - DNA, 22 bp, Homo sapiens
agcagggagcactgagggtggc

SEQ ID NO: 557432 - DNA, 22 bp, Homo sapiens
tctgtgggcctgggctagctgc

SEQ ID NO: 557433 - DNA, 22 bp, Homo sapiens
tggtgactcttatttccaggta

SEQ ID NO: 557434 - DNA, 22 bp, Homo sapiens
tcagactatggaaggttcattc

SEQ ID NO: 557435 - DNA, 22 bp, Homo sapiens
tggtcaagagtgtcaagtgtgc

SEQ ID NO: 557436 - DNA, 22 bp, Homo sapiens
ctgactcacttcagaggggggc

SEQ ID NO: 557437 - DNA, 22 bp, Homo sapiens
taggaaaactggcacaatacta

SEQ ID NO: 557438 - DNA, 22 bp, Homo sapiens
agagagttataaagaaatcatt

SEQ ID NO: 557439 - DNA, 22 bp, Homo sapiens
ggactccctccaggaaattaaa

SEQ ID NO: 557440 - DNA, 22 bp, Homo sapiens
tggtataggggcaggctcatgg

SEQ ID NO: 557441 - DNA, 22 bp, Homo sapiens
caagaatggcatttgatggaag

SEQ ID NO: 557442 - DNA, 22 bp, Homo sapiens
tctgggggtggaggggagggtc

SEQ ID NO: 557443 - DNA, 22 bp, Homo sapiens
cattttcctagtcatgtgcttc

SEQ ID NO: 557444 - DNA, 22 bp, Homo sapiens
tattatttcggttagggctttc

SEQ ID NO: 557445 - DNA, 22 bp, Homo sapiens
tcgtggccaggatctagggttt

SEQ ID NO: 557446 - DNA, 22 bp, Homo sapiens
ggtgagcaggcttctactgtta

SEQ ID NO: 557447 - DNA, 22 bp, Homo sapiens
acttccctgagggcagccgagt

SEQ ID NO: 557448 - DNA, 22 bp, Homo sapiens
ttacttaggatgaaggatgttc

SEQ ID NO: 557449 - DNA, 22 bp, Homo sapiens
caggacatggttcagccagggg

SEQ ID NO: 557450 - DNA, 22 bp, Homo sapiens
aagcttgaagagacttaattat

SEQ ID NO: 557451 - DNA, 22 bp, Homo sapiens
aattagtcacagctagagcctg

SEQ ID NO: 557452 - DNA, 22 bp, Homo sapiens
ttgtcggaactgcatcttatct

SEQ ID NO: 557453 - DNA, 22 bp, Homo sapiens
ttggggaaaactgacaggggag

SEQ ID NO: 557454 - DNA, 22 bp, Homo sapiens
gtcacacacagttgatgagtgt

SEQ ID NO: 557455 - DNA, 22 bp, Homo sapiens
tccttctgtggggaatgtgtcc

SEQ ID NO: 557456 - DNA, 22 bp, Homo sapiens
agctgtgaaatggtgtccctgc

SEQ ID NO: 557457 - DNA, 22 bp, Homo sapiens
tcactggaggtcagtggagcac

SEQ ID NO: 557458 - DNA, 22 bp, Homo sapiens
cgcgcggtggtggtgggctttg

SEQ ID NO: 557459 - DNA, 22 bp, Homo sapiens
tgtctgctattcataaactgct

SEQ ID NO: 557460 - DNA, 22 bp, Homo sapiens
tttttctctccttgatttcgtg

SEQ ID NO: 557461 - DNA, 22 bp, Homo sapiens
aggtatgaaggtgcatcagcct

SEQ ID NO: 557462 - DNA, 22 bp, Homo sapiens
tgggatatcctgttttccattt

SEQ ID NO: 557463 - DNA, 22 bp, Homo sapiens
actggggcacattagggaaggg

SEQ ID NO: 557464 - DNA, 22 bp, Homo sapiens
taaccgagctgtctatatccta

SEQ ID NO: 557465 - DNA, 22 bp, Homo sapiens
cccagcagcctttgcccccatc

SEQ ID NO: 557466 - DNA, 22 bp, Homo sapiens
tgggatggagctgtgtgcaggg

SEQ ID NO: 557467 - DNA, 22 bp, Homo sapiens
tgcctcctcctgcaggctccag

SEQ ID NO: 557468 - DNA, 22 bp, Homo sapiens
tgaccggcctccccccagcctg

SEQ ID NO: 557469 - DNA, 22 bp, Homo sapiens
tctgggtttcatgggcactggc

SEQ ID NO: 557470 - DNA, 22 bp, Homo sapiens
agggagacagcagaaactagag

SEQ ID NO: 557471 - DNA, 22 bp, Homo sapiens
gggcttctttgatgaaagggtt

SEQ ID NO: 557472 - DNA, 22 bp, Homo sapiens
gatgttttctttcgcctttctc

SEQ ID NO: 557473 - DNA, 22 bp, Homo sapiens
ccaactattaggcctttatgtc

SEQ ID NO: 557474 - DNA, 22 bp, Homo sapiens
taaaggttgcacagtctggtct

SEQ ID NO: 557475 - DNA, 22 bp, Homo sapiens
agggaaggccagcatctgaaat

SEQ ID NO: 557476 - DNA, 22 bp, Homo sapiens
ggtagaagtgaggtggagcatg

SEQ ID NO: 557477 - DNA, 22 bp, Homo sapiens
tttccagcaggaattactctga

SEQ ID NO: 557478 - DNA, 22 bp, Homo sapiens
tcttagtggatcatggacccta

SEQ ID NO: 557479 - DNA, 22 bp, Homo sapiens
gaagccagagctggagaggtct

SEQ ID NO: 557480 - DNA, 22 bp, Homo sapiens
tgtcatagtctatgttgccaag

SEQ ID NO: 557481 - DNA, 22 bp, Homo sapiens
acagtcaccctgggagtttggt

SEQ ID NO: 557482 - DNA, 22 bp, Homo sapiens
ggacagggaactttttgatgag

SEQ ID NO: 557483 - DNA, 22 bp, Homo sapiens
acacagaggactcgccatggag

SEQ ID NO: 557484 - DNA, 22 bp, Homo sapiens
actcagcagcccttcgcaggaa

SEQ ID NO: 557485 - DNA, 22 bp, Homo sapiens
tgcctctgcctcactttgcaga

SEQ ID NO: 557486 - DNA, 22 bp, Homo sapiens
caaggttgaatctaggtacctg

SEQ ID NO: 557487 - DNA, 22 bp, Homo sapiens
cttaggctgttgagctcagctc

SEQ ID NO: 557488 - DNA, 22 bp, Homo sapiens
catttatagcagtacaactgag

SEQ ID NO: 557489 - DNA, 22 bp, Homo sapiens
agggtgcacaaagtttagccac

SEQ ID NO: 557490 - DNA, 22 bp, Homo sapiens
gactcccaagacctttccctga

SEQ ID NO: 557491 - DNA, 22 bp, Homo sapiens
gcatagagctccaggcctggga

SEQ ID NO: 557492 - DNA, 22 bp, Homo sapiens
tcgaggctagagtcacgcttgg

SEQ ID NO: 557493 - DNA, 22 bp, Homo sapiens
ccgtcagggtcaggcctctcgg

SEQ ID NO: 557494 - DNA, 22 bp, Homo sapiens
tctgcccccagtgtccctgctt

SEQ ID NO: 557495 - DNA, 22 bp, Homo sapiens
tgtaggagacaagggagaggag

SEQ ID NO: 557496 - DNA, 22 bp, Homo sapiens
cctgctatgcctgaggtgttat

SEQ ID NO: 557497 - DNA, 22 bp, Homo sapiens
tagatggagtaggggctgggct

SEQ ID NO: 557498 - DNA, 22 bp, Homo sapiens
tcacagggctgctgtgagttaa

SEQ ID NO: 557499 - DNA, 22 bp, Homo sapiens
tcttttcattaatagaagttaa

SEQ ID NO: 557500 - DNA, 22 bp, Homo sapiens
tgctgttctcttcctacaatgg

SEQ ID NO: 557501 - DNA, 22 bp, Homo sapiens
tctatttaattcaacctctata

SEQ ID NO: 557502 - DNA, 22 bp, Homo sapiens
tgcccagccctgctcacctccc

SEQ ID NO: 557503 - DNA, 22 bp, Homo sapiens
tgtggagaaggactgttcatgt

SEQ ID NO: 557504 - DNA, 22 bp, Homo sapiens
tggagagacaggtggatatttt

SEQ ID NO: 557505 - DNA, 22 bp, Homo sapiens
ttctggaacccgagcctctggc

SEQ ID NO: 557506 - DNA, 22 bp, Homo sapiens
ttgaattagatgttgtagtcct

SEQ ID NO: 557507 - DNA, 22 bp, Homo sapiens
ttagaaacagttgtcaagtgtg

SEQ ID NO: 557508 - DNA, 22 bp, Homo sapiens
cccgtggtcccagagtcacagg

SEQ ID NO: 557509 - DNA, 22 bp, Homo sapiens
ggcttttagtttccatagaaaa

SEQ ID NO: 557510 - DNA, 22 bp, Homo sapiens
tgtggcctggagtttgatgtag

SEQ ID NO: 557511 - DNA, 22 bp, Homo sapiens
ggaaacagaagggatgcgccaa

SEQ ID NO: 557512 - DNA, 22 bp, Homo sapiens
ttctgtggcagattgggatgga

SEQ ID NO: 557513 - DNA, 22 bp, Homo sapiens
gaagccactggtctatttatat

SEQ ID NO: 557514 - DNA, 22 bp, Homo sapiens
tcccttatcctggacctcttca

SEQ ID NO: 557515 - DNA, 22 bp, Homo sapiens
agatggtatttgtaggaatgcg

SEQ ID NO: 557516 - DNA, 22 bp, Homo sapiens
gagacagaactgtttacctgat

SEQ ID NO: 557517 - DNA, 22 bp, Homo sapiens
tggggggatatgatatcacaga

SEQ ID NO: 557518 - DNA, 22 bp, Homo sapiens
ttgttctgttcctgatgattct

SEQ ID NO: 557519 - DNA, 22 bp, Homo sapiens
tcaggtaaagagagggatttct

SEQ ID NO: 557520 - DNA, 22 bp, Homo sapiens
ggcccttcctccctccctccag

SEQ ID NO: 557521 - DNA, 22 bp, Homo sapiens
taggtcacggtatagtttgaag

SEQ ID NO: 557522 - DNA, 22 bp, Homo sapiens
ggggtggggaaggaggtcacag

SEQ ID NO: 557523 - DNA, 22 bp, Homo sapiens
tttattgctcttatattgcatc

SEQ ID NO: 557524 - DNA, 22 bp, Homo sapiens
aagcctggttgcatgctaatga

SEQ ID NO: 557525 - DNA, 22 bp, Homo sapiens
agtgcatggagatctgctacac

SEQ ID NO: 557526 - DNA, 22 bp, Homo sapiens
tagcaaaagagtccagagtctg

SEQ ID NO: 557527 - DNA, 22 bp, Homo sapiens
gaggcagaattgttacttttag

SEQ ID NO: 557528 - DNA, 22 bp, Homo sapiens
tagaaagatatttggtctttgc

SEQ ID NO: 557529 - DNA, 22 bp, Homo sapiens
tggtatgtgccaggcactgttt

SEQ ID NO: 557530 - DNA, 22 bp, Homo sapiens
ggcgcgggttggggaggatgtt

SEQ ID NO: 557531 - DNA, 22 bp, Homo sapiens
accccagggcctgcagtgggac

SEQ ID NO: 557532 - DNA, 22 bp, Homo sapiens
tgatgacagctagctggctttt

SEQ ID NO: 557533 - DNA, 22 bp, Homo sapiens
tgtgattcaacaaattgaggat

SEQ ID NO: 557534 - DNA, 22 bp, Homo sapiens
tttgttcatgacattataatca

SEQ ID NO: 557535 - DNA, 22 bp, Homo sapiens
taggtatgcagcctatttgcca

SEQ ID NO: 557536 - DNA, 22 bp, Homo sapiens
gatattatgtccctaatataca

SEQ ID NO: 557537 - DNA, 22 bp, Homo sapiens
tttgaaacttgacagatgtgtg

SEQ ID NO: 557538 - DNA, 22 bp, Homo sapiens
ggctgtggggattgttgcttat

SEQ ID NO: 557539 - DNA, 22 bp, Homo sapiens
gaagagcccacagtttagtttg

SEQ ID NO: 557540 - DNA, 22 bp, Homo sapiens
ttagccacctgctgttttcttc

SEQ ID NO: 557541 - DNA, 22 bp, Homo sapiens
tccattcgtgggctgcattttc

SEQ ID NO: 557542 - DNA, 22 bp, Homo sapiens
tcacatttttatagcaggagct

SEQ ID NO: 557543 - DNA, 22 bp, Homo sapiens
cagtgcccagagagcatctgtt

SEQ ID NO: 557544 - DNA, 22 bp, Homo sapiens
aaatggtgcactctgctctgat

SEQ ID NO: 557545 - DNA, 22 bp, Homo sapiens
gccctcctttgcccgtgaatgg

SEQ ID NO: 557546 - DNA, 22 bp, Homo sapiens
ggccccagatgtttgaaagact

SEQ ID NO: 557547 - DNA, 22 bp, Homo sapiens
tctgtgttttcttaccactgtg

SEQ ID NO: 557548 - DNA, 22 bp, Homo sapiens
ttacttcaggggaggtttgtga

SEQ ID NO: 557549 - DNA, 22 bp, Homo sapiens
tagctttttgagctattctcag

SEQ ID NO: 557550 - DNA, 22 bp, Homo sapiens
tagtgattaaacctccataaat

SEQ ID NO: 557551 - DNA, 22 bp, Homo sapiens
agtagcgagggaatggtgccgc

SEQ ID NO: 557552 - DNA, 22 bp, Homo sapiens
tctgtgagctgctggaccccct

SEQ ID NO: 557553 - DNA, 22 bp, Homo sapiens
actaaatatgcacatgggtatt

SEQ ID NO: 557554 - DNA, 22 bp, Homo sapiens
tattttccacttgtggaaagag

SEQ ID NO: 557555 - DNA, 22 bp, Homo sapiens
gaaagctgtgttggagaggcag

SEQ ID NO: 557556 - DNA, 22 bp, Homo sapiens
tggacacagattgaagaatctg

SEQ ID NO: 557557 - DNA, 22 bp, Homo sapiens
ttttagatagaggtggagtatg

SEQ ID NO: 557558 - DNA, 22 bp, Homo sapiens
atttagccaacatatttgttaa

SEQ ID NO: 557559 - DNA, 22 bp, Homo sapiens
tataggaaaccagatgtaaata

SEQ ID NO: 557560 - DNA, 22 bp, Homo sapiens
ctctttcctcaagttggtgttg

SEQ ID NO: 557561 - DNA, 22 bp, Homo sapiens
ttaagtagaactctgcccatga

SEQ ID NO: 557562 - DNA, 22 bp, Homo sapiens
aattattcccaggcagagagcc

SEQ ID NO: 557563 - DNA, 22 bp, Homo sapiens
ggaggtggcagggaacataatt

SEQ ID NO: 557564 - DNA, 22 bp, Homo sapiens
tcaatttgtctttcccaaggtg

SEQ ID NO: 557565 - DNA, 22 bp, Homo sapiens
tttcaggggaaagactgggttt

SEQ ID NO: 557566 - DNA, 22 bp, Homo sapiens
catttccaaagtgtcttttaag

SEQ ID NO: 557567 - DNA, 22 bp, Homo sapiens
tctagacagggaggagaagttg

SEQ ID NO: 557568 - DNA, 22 bp, Homo sapiens
ttgattctctatctcccctatc

SEQ ID NO: 557569 - DNA, 22 bp, Homo sapiens
tcagagccagggaatggggtga

SEQ ID NO: 557570 - DNA, 22 bp, Homo sapiens
ttttcttttgttccatgctggc

SEQ ID NO: 557571 - DNA, 22 bp, Homo sapiens
cgggaaccgggagggagcgggc

SEQ ID NO: 557572 - DNA, 22 bp, Homo sapiens
tggagagtcactagttagtgct

SEQ ID NO: 557573 - DNA, 22 bp, Homo sapiens
tcaggagtacctgcttattgca

SEQ ID NO: 557574 - DNA, 22 bp, Homo sapiens
gcaatgccttatctatggttct

SEQ ID NO: 557575 - DNA, 22 bp, Homo sapiens
ggagaggagagtgttgagcaca

SEQ ID NO: 557576 - DNA, 22 bp, Homo sapiens
gcatttagtgcaggacacacag

SEQ ID NO: 557577 - DNA, 22 bp, Homo sapiens
tggtatcaggactcctgggata

SEQ ID NO: 557578 - DNA, 22 bp, Homo sapiens
tgcagcagggagaaggaagtgg

SEQ ID NO: 557579 - DNA, 22 bp, Homo sapiens
ggtgggcagaggggaggcgggg

SEQ ID NO: 557580 - DNA, 22 bp, Homo sapiens
tgacctacttttccctctcata

SEQ ID NO: 557581 - DNA, 22 bp, Homo sapiens
ttacttccctccccataaccca

SEQ ID NO: 557582 - DNA, 22 bp, Homo sapiens
ctactatatctgaaaatttcaa

SEQ ID NO: 557583 - DNA, 22 bp, Homo sapiens
ggctctctctccccacgatccc

SEQ ID NO: 557584 - DNA, 22 bp, Homo sapiens
actccggcaggctggaggtgcc

SEQ ID NO: 557585 - DNA, 22 bp, Homo sapiens
cgcgcgtggggctggcgcgccg

SEQ ID NO: 557586 - DNA, 22 bp, Homo sapiens
ttaatgcctgttattttggaag

SEQ ID NO: 557587 - DNA, 22 bp, Homo sapiens
ggtcctcaataagtatttgttg

SEQ ID NO: 557588 - DNA, 22 bp, Homo sapiens
agtgggatgagttagaggtgtc

SEQ ID NO: 557589 - DNA, 22 bp, Homo sapiens
aaggctagtgcatggaacctcc

SEQ ID NO: 557590 - DNA, 22 bp, Homo sapiens
cctggagccactgttctcattc

SEQ ID NO: 557591 - DNA, 22 bp, Homo sapiens
caagagaaccctgcctctcctg

SEQ ID NO: 557592 - DNA, 22 bp, Homo sapiens
gctgggctccaggagtggcctg

SEQ ID NO: 557593 - DNA, 22 bp, Homo sapiens
tgtggttactcagaaaccagca

SEQ ID NO: 557594 - DNA, 22 bp, Homo sapiens
tgctgccttcagtctcttcaag

SEQ ID NO: 557595 - DNA, 22 bp, Homo sapiens
agagtcttgtcaaattagcctt

SEQ ID NO: 557596 - DNA, 22 bp, Homo sapiens
tggaggctggggagcgagcctg

SEQ ID NO: 557597 - DNA, 22 bp, Homo sapiens
aggatggtccagggaatcctat

SEQ ID NO: 557598 - DNA, 22 bp, Homo sapiens
taggtccaagattccaggtctt

SEQ ID NO: 557599 - DNA, 22 bp, Homo sapiens
atttctctcaagcaaatctatg

SEQ ID NO: 557600 - DNA, 22 bp, Homo sapiens
ttctgggctcttaactgtatga

SEQ ID NO: 557601 - DNA, 22 bp, Homo sapiens
ttttctctgacctccttcccag

SEQ ID NO: 557602 - DNA, 22 bp, Homo sapiens
tgaaggaccagctccttaccct

SEQ ID NO: 557603 - DNA, 22 bp, Homo sapiens
cccggagctgaagcctctctgt

SEQ ID NO: 557604 - DNA, 22 bp, Homo sapiens
gctctgagacaggtgcctttag

SEQ ID NO: 557605 - DNA, 22 bp, Homo sapiens
ttttgttatttcctacctgaca

SEQ ID NO: 557606 - DNA, 22 bp, Homo sapiens
agaggcctccctcccagctggt

SEQ ID NO: 557607 - DNA, 22 bp, Homo sapiens
ggcctaaagccagaagcaggaa

SEQ ID NO: 557608 - DNA, 22 bp, Homo sapiens
atgtgtttgaatggaagcactt

SEQ ID NO: 557609 - DNA, 22 bp, Homo sapiens
aagcatgttctcttcctcattc

SEQ ID NO: 557610 - DNA, 22 bp, Homo sapiens
aatgcatactgggacttgtagt

SEQ ID NO: 557611 - DNA, 22 bp, Homo sapiens
ggtgcagagtggccaggaggtg

SEQ ID NO: 557612 - DNA, 22 bp, Homo sapiens
tgttgtgccttagtccctgcct

SEQ ID NO: 557613 - DNA, 22 bp, Homo sapiens
tcctctgtgtgtgtcctgcact

SEQ ID NO: 557614 - DNA, 22 bp, Homo sapiens
gcctgcctgggaagggtattgc

SEQ ID NO: 557615 - DNA, 22 bp, Homo sapiens
aggaaaggctctgggtaattga

SEQ ID NO: 557616 - DNA, 22 bp, Homo sapiens
tgcaccatggttgtctgagcat

SEQ ID NO: 557617 - DNA, 22 bp, Homo sapiens
aagcatatagaaaggttttggg

SEQ ID NO: 557618 - DNA, 22 bp, Homo sapiens
acgccttgcagggatgcagtga

SEQ ID NO: 557619 - DNA, 22 bp, Homo sapiens
tggagcacaccagtaaaattga

SEQ ID NO: 557620 - DNA, 22 bp, Homo sapiens
tgcggatctaaggctgggaggg

SEQ ID NO: 557621 - DNA, 22 bp, Homo sapiens
gtctgggcatacagatttggga

SEQ ID NO: 557622 - DNA, 22 bp, Homo sapiens
tgtgctcattcccgtctcccgt

SEQ ID NO: 557623 - DNA, 22 bp, Homo sapiens
gaagctgggggcaacacctgaa

SEQ ID NO: 557624 - DNA, 22 bp, Homo sapiens
tgaagagaggggcctttgtgat

SEQ ID NO: 557625 - DNA, 22 bp, Homo sapiens
ccagtgtgattttctggccagt

SEQ ID NO: 557626 - DNA, 22 bp, Homo sapiens
tctgtgataccatcaataccaa

SEQ ID NO: 557627 - DNA, 22 bp, Homo sapiens
cggcccccagcacccgcccctt

SEQ ID NO: 557628 - DNA, 22 bp, Homo sapiens
tctttcccagggagcttctgag

SEQ ID NO: 557629 - DNA, 22 bp, Homo sapiens
tttttagttattcctaaagggt

SEQ ID NO: 557630 - DNA, 22 bp, Homo sapiens
acaggtgctgctggctgtggag

SEQ ID NO: 557631 - DNA, 22 bp, Homo sapiens
tattccaggagtccagggtttc

SEQ ID NO: 557632 - DNA, 22 bp, Homo sapiens
gtcaggcacagttgattatgtg

SEQ ID NO: 557633 - DNA, 22 bp, Homo sapiens
ttttgcagctctggaatctgag

SEQ ID NO: 557634 - DNA, 22 bp, Homo sapiens
tatatatcctgcagctcatgct

SEQ ID NO: 557635 - DNA, 22 bp, Homo sapiens
ttgattgacacttctgtgagta

SEQ ID NO: 557636 - DNA, 22 bp, Homo sapiens
tttctcagtttggaaagaatgc

SEQ ID NO: 557637 - DNA, 22 bp, Homo sapiens
gcgggagcagccttcagtgtct

SEQ ID NO: 557638 - DNA, 22 bp, Homo sapiens
tggccgtgcatgatatggctgc

SEQ ID NO: 557639 - DNA, 22 bp, Homo sapiens
gggcacttttggcatccctcca

SEQ ID NO: 557640 - DNA, 22 bp, Homo sapiens
gttcggtggaagggggaattcc

SEQ ID NO: 557641 - DNA, 22 bp, Homo sapiens
tccattttccaccagagctgca

SEQ ID NO: 557642 - DNA, 22 bp, Homo sapiens
aagtgacatcacagtgaccaga

SEQ ID NO: 557643 - DNA, 22 bp, Homo sapiens
gacagggctccccgcaccgcag

SEQ ID NO: 557644 - DNA, 22 bp, Homo sapiens
tggtgggtcattcctccaatga

SEQ ID NO: 557645 - DNA, 22 bp, Homo sapiens
ttcgatgaccatatgtgacatg

SEQ ID NO: 557646 - DNA, 22 bp, Homo sapiens
ggtccctgcagcggggcagaca

SEQ ID NO: 557647 - DNA, 22 bp, Homo sapiens
cacaccatgataaagagttttg

SEQ ID NO: 557648 - DNA, 22 bp, Homo sapiens
cgtacacctctcacacactgct

SEQ ID NO: 557649 - DNA, 22 bp, Homo sapiens
tcccatcttacattgaacaaag

SEQ ID NO: 557650 - DNA, 22 bp, Homo sapiens
tgataaaatgatgaaatcactg

SEQ ID NO: 557651 - DNA, 22 bp, Homo sapiens
tcccattggggctgttttatgc

SEQ ID NO: 557652 - DNA, 22 bp, Homo sapiens
tgggttggggagagatgaagac

SEQ ID NO: 557653 - DNA, 22 bp, Homo sapiens
tgagctcttgtaaggtgccata

SEQ ID NO: 557654 - DNA, 22 bp, Homo sapiens
tgaggtgccggctggagtttct

SEQ ID NO: 557655 - DNA, 22 bp, Homo sapiens
caggtaaaccaccaaatctcag

SEQ ID NO: 557656 - DNA, 22 bp, Homo sapiens
ttttctgctgtcttggagatct

SEQ ID NO: 557657 - DNA, 22 bp, Homo sapiens
gcctgagagaacaatgatgctg

SEQ ID NO: 557658 - DNA, 22 bp, Homo sapiens
ttgtcatagaagtaaatgaaaa

SEQ ID NO: 557659 - DNA, 22 bp, Homo sapiens
tggcaccgggagcaggtgtggg

SEQ ID NO: 557660 - DNA, 22 bp, Homo sapiens
catgtggtcattaattttgttg

SEQ ID NO: 557661 - DNA, 22 bp, Homo sapiens
ctgctggcagtttgccctggga

SEQ ID NO: 557662 - DNA, 22 bp, Homo sapiens
tctgcaattccacaagctgact

SEQ ID NO: 557663 - DNA, 22 bp, Homo sapiens
ggccaataagaatgccagctcc

SEQ ID NO: 557664 - DNA, 22 bp, Homo sapiens
ctgtaggacatgactcactgga

SEQ ID NO: 557665 - DNA, 22 bp, Homo sapiens
acaatgcttggtatgaatgtca

SEQ ID NO: 557666 - DNA, 22 bp, Homo sapiens
gaagagtttatgagagtttgag

SEQ ID NO: 557667 - DNA, 22 bp, Homo sapiens
ccgcctctgttattataagttg

SEQ ID NO: 557668 - DNA, 22 bp, Homo sapiens
ttcaggaagatttggaaaagaa

SEQ ID NO: 557669 - DNA, 22 bp, Homo sapiens
tggagtaggtggtgcattgtcc

SEQ ID NO: 557670 - DNA, 22 bp, Homo sapiens
ccagtaataaagagcctgcaaa

SEQ ID NO: 557671 - DNA, 22 bp, Homo sapiens
ctaaggaggacagaggggagga

SEQ ID NO: 557672 - DNA, 22 bp, Homo sapiens
gggtgtgctcagagcagggggc

SEQ ID NO: 557673 - DNA, 22 bp, Homo sapiens
tagattgccaggaaatcagatt

SEQ ID NO: 557674 - DNA, 22 bp, Homo sapiens
agtgaggcacttcccttctcca

SEQ ID NO: 557675 - DNA, 22 bp, Homo sapiens
tttttccatattggaagagaaa

SEQ ID NO: 557676 - DNA, 22 bp, Homo sapiens
tactattctatgctttttggac

SEQ ID NO: 557677 - DNA, 22 bp, Homo sapiens
gaactgcttggacttttgagct

SEQ ID NO: 557678 - DNA, 22 bp, Homo sapiens
tcggggatcatcatgtcacgag

SEQ ID NO: 557679 - DNA, 22 bp, Homo sapiens
tcaatttttctgtggcttatgt

SEQ ID NO: 557680 - DNA, 22 bp, Homo sapiens
agccccgctgccttcacgtctg

SEQ ID NO: 557681 - DNA, 22 bp, Homo sapiens
gcattcccggccccctggcgac

SEQ ID NO: 557682 - DNA, 22 bp, Homo sapiens
gtgaggcagttctgggcctgca

SEQ ID NO: 557683 - DNA, 22 bp, Homo sapiens
tgccatctgccctggccatgcc

SEQ ID NO: 557684 - DNA, 22 bp, Homo sapiens
tctggattttccctatggctag

SEQ ID NO: 557685 - DNA, 22 bp, Homo sapiens
tctgttgttgctgtgcgtcctg

SEQ ID NO: 557686 - DNA, 22 bp, Homo sapiens
ctgaaactgcaggaattcatga

SEQ ID NO: 557687 - DNA, 22 bp, Homo sapiens
tgactgacaagcctttcgctga

SEQ ID NO: 557688 - DNA, 22 bp, Homo sapiens
agcttctccatgctggtgctca

SEQ ID NO: 557689 - DNA, 22 bp, Homo sapiens
gatctcggtagttcagtagcac

SEQ ID NO: 557690 - DNA, 22 bp, Homo sapiens
tgaattttgcccacaatgggct

SEQ ID NO: 557691 - DNA, 22 bp, Homo sapiens
agaccaggggcccgggacatga

SEQ ID NO: 557692 - DNA, 22 bp, Homo sapiens
cctgaatgctattccttggcga

SEQ ID NO: 557693 - DNA, 22 bp, Homo sapiens
caccattagagcagaatggaga

SEQ ID NO: 557694 - DNA, 22 bp, Homo sapiens
cagtttggaggagaaagtgcgg

SEQ ID NO: 557695 - DNA, 22 bp, Homo sapiens
ttattcattgttgaatcctcag

SEQ ID NO: 557696 - DNA, 22 bp, Homo sapiens
ttgcctaggtaccggcagaccc

SEQ ID NO: 557697 - DNA, 22 bp, Homo sapiens
cggcacatcttaattgttactg

SEQ ID NO: 557698 - DNA, 22 bp, Homo sapiens
tttatctttttctccagatgcc

SEQ ID NO: 557699 - DNA, 22 bp, Homo sapiens
ttatggaataatcattctccgg

SEQ ID NO: 557700 - DNA, 22 bp, Homo sapiens
tgttctgatttaatgaggccat

SEQ ID NO: 557701 - DNA, 22 bp, Homo sapiens
tgctggaccatggcccaccctc

SEQ ID NO: 557702 - DNA, 22 bp, Homo sapiens
ttgatattttaaggtctgagac

SEQ ID NO: 557703 - DNA, 22 bp, Homo sapiens
ggttctggggagtttgtggggc

SEQ ID NO: 557704 - DNA, 22 bp, Homo sapiens
tggctgtaaaggcaacaagaaa

SEQ ID NO: 557705 - DNA, 22 bp, Homo sapiens
ggcctcccacctcctagggctc

SEQ ID NO: 557706 - DNA, 22 bp, Homo sapiens
ttggggctgcgtatttccatgt

SEQ ID NO: 557707 - DNA, 22 bp, Homo sapiens
tcatccatgatgggggggtaca

SEQ ID NO: 557708 - DNA, 22 bp, Homo sapiens
agttccagaagaagcagggggt

SEQ ID NO: 557709 - DNA, 22 bp, Homo sapiens
tgatccctaatgtgcacaggaa

SEQ ID NO: 557710 - DNA, 22 bp, Homo sapiens
tgggccctgggccactcctggc

SEQ ID NO: 557711 - DNA, 22 bp, Homo sapiens
gaggccattttcacagcttctg

SEQ ID NO: 557712 - DNA, 22 bp, Homo sapiens
ttccagtcctgttccttctacc

SEQ ID NO: 557713 - DNA, 22 bp, Homo sapiens
tagagtttgtagtgttggggtc

SEQ ID NO: 557714 - DNA, 22 bp, Homo sapiens
gtcagcaagttcagagaaggtt

SEQ ID NO: 557715 - DNA, 22 bp, Homo sapiens
accctctgcaggccacccccac

SEQ ID NO: 557716 - DNA, 22 bp, Homo sapiens
tggccttggcagggcggacacg

SEQ ID NO: 557717 - DNA, 22 bp, Homo sapiens
ttctccaaaagggagcactttc

SEQ ID NO: 557718 - DNA, 22 bp, Homo sapiens
tctgcttagcccatctgcctgt

SEQ ID NO: 557719 - DNA, 22 bp, Homo sapiens
tgcattttgctaacagcctgtc

SEQ ID NO: 557720 - DNA, 22 bp, Homo sapiens
ttgacagaaccaaaaagggcct

SEQ ID NO: 557721 - DNA, 22 bp, Homo sapiens
tgttctcactctttctgctgtt

SEQ ID NO: 557722 - DNA, 22 bp, Homo sapiens
tgaaaaacgtgcaaactgtctt

SEQ ID NO: 557723 - DNA, 22 bp, Homo sapiens
gagaagttgcccgtgttttttt

SEQ ID NO: 557724 - DNA, 22 bp, Homo sapiens
gagggagggggaacggtgttcg

SEQ ID NO: 557725 - DNA, 22 bp, Homo sapiens
gcaggtgattatagtaaacata

SEQ ID NO: 557726 - DNA, 22 bp, Homo sapiens
ttggctagctgctttctcttgg

SEQ ID NO: 557727 - DNA, 22 bp, Homo sapiens
cgtgactcactggcaaagatct

SEQ ID NO: 557728 - DNA, 22 bp, Homo sapiens
cattttaaatggcgagaacagt

SEQ ID NO: 557729 - DNA, 22 bp, Homo sapiens
tttgtgaccttgcattctttcc

SEQ ID NO: 557730 - DNA, 22 bp, Homo sapiens
gaacatagtggactttggcaaa

SEQ ID NO: 557731 - DNA, 22 bp, Homo sapiens
acaaaacttgttttcctttctt

SEQ ID NO: 557732 - DNA, 22 bp, Homo sapiens
aagaaattcactcctgggctga

SEQ ID NO: 557733 - DNA, 22 bp, Homo sapiens
gacagctggcctggcggcctcc

SEQ ID NO: 557734 - DNA, 22 bp, Homo sapiens
gggagtcccagaggggtgacag

SEQ ID NO: 557735 - DNA, 22 bp, Homo sapiens
tggaggctgctgggtgacctcg

SEQ ID NO: 557736 - DNA, 22 bp, Homo sapiens
gtgagccagcttccttgacact

SEQ ID NO: 557737 - DNA, 22 bp, Homo sapiens
cttgacagatggtgttagaagt

SEQ ID NO: 557738 - DNA, 22 bp, Homo sapiens
tgttccaggtgctgtctctggt

SEQ ID NO: 557739 - DNA, 22 bp, Homo sapiens
tcggttctgagagccgcttaga

SEQ ID NO: 557740 - DNA, 22 bp, Homo sapiens
ttttaatttgggagcatgctga

SEQ ID NO: 557741 - DNA, 22 bp, Homo sapiens
ttgtagttaatgagtctgtgct

SEQ ID NO: 557742 - DNA, 22 bp, Homo sapiens
cctggtcccgtggctgagagtg

SEQ ID NO: 557743 - DNA, 22 bp, Homo sapiens
tacttactcctgtcaatttcca

SEQ ID NO: 557744 - DNA, 22 bp, Homo sapiens
ggtggatgttccttctatgctt

SEQ ID NO: 557745 - DNA, 22 bp, Homo sapiens
agcgggttaggctcggggaatt

SEQ ID NO: 557746 - DNA, 22 bp, Homo sapiens
gatcgtcaaagggaatggatca

SEQ ID NO: 557747 - DNA, 22 bp, Homo sapiens
tgggaggtgagtcactaaaaag

SEQ ID NO: 557748 - DNA, 22 bp, Homo sapiens
agaaaggcatggaggcaaactt

SEQ ID NO: 557749 - DNA, 22 bp, Homo sapiens
gcctgcggtgggccaggtgctc

SEQ ID NO: 557750 - DNA, 22 bp, Homo sapiens
tgtcactgtgtgatgttcttct

SEQ ID NO: 557751 - DNA, 22 bp, Homo sapiens
acctcctgctccccgacagcct

SEQ ID NO: 557752 - DNA, 22 bp, Homo sapiens
gtgctgagattgaggctggggt

SEQ ID NO: 557753 - DNA, 22 bp, Homo sapiens
gcttaagaaacacttcctgggt

SEQ ID NO: 557754 - DNA, 22 bp, Homo sapiens
tgggctctcctctctcagacag

SEQ ID NO: 557755 - DNA, 22 bp, Homo sapiens
tgctaaggctcctcctgtcttc

SEQ ID NO: 557756 - DNA, 22 bp, Homo sapiens
aaacttggtggtgacagcagta

SEQ ID NO: 557757 - DNA, 22 bp, Homo sapiens
tttccccatagcatccccttgg

SEQ ID NO: 557758 - DNA, 22 bp, Homo sapiens
cgcggaaggaggcggggcgggg

SEQ ID NO: 557759 - DNA, 22 bp, Homo sapiens
ttcaaactgcctttcctgttga

SEQ ID NO: 557760 - DNA, 22 bp, Homo sapiens
tcagtctctggaccatgtctac

SEQ ID NO: 557761 - DNA, 22 bp, Homo sapiens
ttaacctcagcgggccattaat

SEQ ID NO: 557762 - DNA, 22 bp, Homo sapiens
tttgccacccccagagccttga

SEQ ID NO: 557763 - DNA, 22 bp, Homo sapiens
gatagcctggtctgggggagaa

SEQ ID NO: 557764 - DNA, 22 bp, Homo sapiens
atcaatgaatgcaatgttgtgc

SEQ ID NO: 557765 - DNA, 22 bp, Homo sapiens
atccacatgtttgatgtcatgc

SEQ ID NO: 557766 - DNA, 22 bp, Homo sapiens
cgtggctggaggacctcgtgtc

SEQ ID NO: 557767 - DNA, 22 bp, Homo sapiens
ttctaacattctgtgattcttg

SEQ ID NO: 557768 - DNA, 22 bp, Homo sapiens
ttgtggctcctggttgctagga

SEQ ID NO: 557769 - DNA, 22 bp, Homo sapiens
ttgaaggttctaccacaccagt

SEQ ID NO: 557770 - DNA, 22 bp, Homo sapiens
cctgtggagatgtagatgggag

SEQ ID NO: 557771 - DNA, 22 bp, Homo sapiens
tgagcgaagcccaggcattcag

SEQ ID NO: 557772 - DNA, 22 bp, Homo sapiens
tatttcaagacaccaataagca

SEQ ID NO: 557773 - DNA, 22 bp, Homo sapiens
tttctgaacctgtttaataatg

SEQ ID NO: 557774 - DNA, 22 bp, Homo sapiens
agggcggagtagtgaggagacc

SEQ ID NO: 557775 - DNA, 22 bp, Homo sapiens
ggattgtaaagttgacaaatat

SEQ ID NO: 557776 - DNA, 22 bp, Homo sapiens
tgcagtgctgggggaggttgtg

SEQ ID NO: 557777 - DNA, 22 bp, Homo sapiens
tgggcacaggtgcacacacagg

SEQ ID NO: 557778 - DNA, 22 bp, Homo sapiens
aggaatccttgcttattggatg

SEQ ID NO: 557779 - DNA, 22 bp, Homo sapiens
tgttcttttggaattaggcttc

SEQ ID NO: 557780 - DNA, 22 bp, Homo sapiens
gagtgcaggctggtggaattcg

SEQ ID NO: 557781 - DNA, 22 bp, Homo sapiens
cttcaaggttcttggcaggaat

SEQ ID NO: 557782 - DNA, 22 bp, Homo sapiens
tagctggttaaatcagagctct

SEQ ID NO: 557783 - DNA, 22 bp, Homo sapiens
tctccattacactaccctgcct

SEQ ID NO: 557784 - DNA, 22 bp, Homo sapiens
tcccccccatcccctttctacc

SEQ ID NO: 557785 - DNA, 22 bp, Homo sapiens
tggcagcaactgtgaactcctc

SEQ ID NO: 557786 - DNA, 22 bp, Homo sapiens
tctggagtcagaatgtctggtt

SEQ ID NO: 557787 - DNA, 22 bp, Homo sapiens
gctggcccctccctccagggct

SEQ ID NO: 557788 - DNA, 22 bp, Homo sapiens
tcttgcttccaactctcattat

SEQ ID NO: 557789 - DNA, 22 bp, Homo sapiens
gactaggagaggtgagaaagtg

SEQ ID NO: 557790 - DNA, 22 bp, Homo sapiens
gtctgcaattgtgctcctttct

SEQ ID NO: 557791 - DNA, 22 bp, Homo sapiens
ttttttgttgttacaaaacacc

SEQ ID NO: 557792 - DNA, 22 bp, Homo sapiens
tctagagcagtgaagaagaaca

SEQ ID NO: 557793 - DNA, 22 bp, Homo sapiens
tcagggagtttggcacgtggga

SEQ ID NO: 557794 - DNA, 22 bp, Homo sapiens
actcttcctccgacatcctctc

SEQ ID NO: 557795 - DNA, 22 bp, Homo sapiens
tagaaattaggaggttatcccc

SEQ ID NO: 557796 - DNA, 22 bp, Homo sapiens
tctgagtccactaggatttggc

SEQ ID NO: 557797 - DNA, 22 bp, Homo sapiens
gttccaaagacagaaagcttgt

SEQ ID NO: 557798 - DNA, 22 bp, Homo sapiens
tcctttgtttgtgactatgaaa

SEQ ID NO: 557799 - DNA, 22 bp, Homo sapiens
tttcccaaatgtaaattccatc

SEQ ID NO: 557800 - DNA, 22 bp, Homo sapiens
caactatgcaggcagactgagt

SEQ ID NO: 557801 - DNA, 22 bp, Homo sapiens
gccatctatttttttctcagag

SEQ ID NO: 557802 - DNA, 22 bp, Homo sapiens
ccaatgaagatagtaaaaatgc

SEQ ID NO: 557803 - DNA, 22 bp, Homo sapiens
tcgtgtctctccagggctgcac

SEQ ID NO: 557804 - DNA, 22 bp, Homo sapiens
gttgaatttttgacggagcctg

SEQ ID NO: 557805 - DNA, 22 bp, Homo sapiens
ggctgtgtctgggcagatgggg

SEQ ID NO: 557806 - DNA, 22 bp, Homo sapiens
ttgggtaaggaaggagaaattg

SEQ ID NO: 557807 - DNA, 22 bp, Homo sapiens
agcccagtggctccgccttcac

SEQ ID NO: 557808 - DNA, 22 bp, Homo sapiens
gcgtgtggtcagcggcgggcgt

SEQ ID NO: 557809 - DNA, 22 bp, Homo sapiens
tcttaaagaagaaataagatac

SEQ ID NO: 557810 - DNA, 22 bp, Homo sapiens
gccccctcccccacctgcaggc

SEQ ID NO: 557811 - DNA, 22 bp, Homo sapiens
ggcttcagcgatggtgcgaggg

SEQ ID NO: 557812 - DNA, 22 bp, Homo sapiens
acaggggttctcctggagtacc

SEQ ID NO: 557813 - DNA, 22 bp, Homo sapiens
ctcattgtcttttctgtcaatt

SEQ ID NO: 557814 - DNA, 22 bp, Homo sapiens
cctcatggagcttgcatctagt

SEQ ID NO: 557815 - DNA, 22 bp, Homo sapiens
gggggagtccagacaacaggcg

SEQ ID NO: 557816 - DNA, 22 bp, Homo sapiens
tgaaggaggcagaccagggatt

SEQ ID NO: 557817 - DNA, 22 bp, Homo sapiens
ctaattgtacccccaagtgaga

SEQ ID NO: 557818 - DNA, 22 bp, Homo sapiens
tgacattcatcttcatgagtga

SEQ ID NO: 557819 - DNA, 22 bp, Homo sapiens
ggaataggagggaggagatgga

SEQ ID NO: 557820 - DNA, 22 bp, Homo sapiens
actgggtcaggggagggcagaa

SEQ ID NO: 557821 - DNA, 22 bp, Homo sapiens
tgaggccaccagggtactattc

SEQ ID NO: 557822 - DNA, 22 bp, Homo sapiens
cagtgctgccacctcgttccca

SEQ ID NO: 557823 - DNA, 22 bp, Homo sapiens
tgtactgcagggagagcaaagg

SEQ ID NO: 557824 - DNA, 22 bp, Homo sapiens
tggctagcatttaaaatcgacc

SEQ ID NO: 557825 - DNA, 22 bp, Homo sapiens
ttcctagcactgctaagcaaga

SEQ ID NO: 557826 - DNA, 22 bp, Homo sapiens
ctaggcctttcttctgtggatc

SEQ ID NO: 557827 - DNA, 22 bp, Homo sapiens
atggctattccattgaaagtca

SEQ ID NO: 557828 - DNA, 22 bp, Homo sapiens
tgctttgtttccaaaagcctga

SEQ ID NO: 557829 - DNA, 22 bp, Homo sapiens
aggacataagctgggggcagag

SEQ ID NO: 557830 - DNA, 22 bp, Homo sapiens
tgtatctgtgtgcactttggtg

SEQ ID NO: 557831 - DNA, 22 bp, Homo sapiens
tagcttagcacggtttacttaa

SEQ ID NO: 557832 - DNA, 22 bp, Homo sapiens
tgacaataataatagatgagtg

SEQ ID NO: 557833 - DNA, 22 bp, Homo sapiens
cgggttgactataaatgaaggc

SEQ ID NO: 557834 - DNA, 22 bp, Homo sapiens
gcatgatatttgacagatggag

SEQ ID NO: 557835 - DNA, 22 bp, Homo sapiens
tgtgaccatcctcactgagctg

SEQ ID NO: 557836 - DNA, 22 bp, Homo sapiens
caccttactcccaggtgttcgt

SEQ ID NO: 557837 - DNA, 22 bp, Homo sapiens
gcagggggcggaggccgctgtg

SEQ ID NO: 557838 - DNA, 22 bp, Homo sapiens
ttatttaaaagacttaattgga

SEQ ID NO: 557839 - DNA, 22 bp, Homo sapiens
agagctcctgcctgagctggac

SEQ ID NO: 557840 - DNA, 22 bp, Homo sapiens
tgcctccaccccgcctggcctg

SEQ ID NO: 557841 - DNA, 22 bp, Homo sapiens
tccatgtgaactcacttttcac

SEQ ID NO: 557842 - DNA, 22 bp, Homo sapiens
ttagacctgtttctctgccaga

SEQ ID NO: 557843 - DNA, 22 bp, Homo sapiens
tctcacccacctttggcatgat

SEQ ID NO: 557844 - DNA, 22 bp, Homo sapiens
ggtgcagggaggatcagctgca

SEQ ID NO: 557845 - DNA, 22 bp, Homo sapiens
gtctgttagggcggctgtcttg

SEQ ID NO: 557846 - DNA, 22 bp, Homo sapiens
aagtggggagtgggcaagcggg

SEQ ID NO: 557847 - DNA, 22 bp, Homo sapiens
aggtaaagatgagctcagtgtc

SEQ ID NO: 557848 - DNA, 22 bp, Homo sapiens
ccaagggcagggactgcagagg

SEQ ID NO: 557849 - DNA, 22 bp, Homo sapiens
cctgccacttcctgcctcagtc

SEQ ID NO: 557850 - DNA, 22 bp, Homo sapiens
taggaagtttaggaaattgttc

SEQ ID NO: 557851 - DNA, 22 bp, Homo sapiens
ctactgtctgcttccactgcct

SEQ ID NO: 557852 - DNA, 22 bp, Homo sapiens
tcagttaacggaaaggggtgtg

SEQ ID NO: 557853 - DNA, 22 bp, Homo sapiens
cagcatagggcagttaggagat

SEQ ID NO: 557854 - DNA, 22 bp, Homo sapiens
gaggcagtggaagggaaagtat

SEQ ID NO: 557855 - DNA, 22 bp, Homo sapiens
tgagggtgcctgggccatctct

SEQ ID NO: 557856 - DNA, 22 bp, Homo sapiens
ttccctttctgacccctcctcc

SEQ ID NO: 557857 - DNA, 22 bp, Homo sapiens
tagcatttgccaaccagtggca

SEQ ID NO: 557858 - DNA, 22 bp, Homo sapiens
ggcagcagggatgggtgggagc

SEQ ID NO: 557859 - DNA, 22 bp, Homo sapiens
gtgtgctagggccagatcatcc

SEQ ID NO: 557860 - DNA, 22 bp, Homo sapiens
tgcatctgctgttgcttgacca

SEQ ID NO: 557861 - DNA, 22 bp, Homo sapiens
tccatagcccaggaatgaccac

SEQ ID NO: 557862 - DNA, 22 bp, Homo sapiens
ccagttttaggcaaagctgtga

SEQ ID NO: 557863 - DNA, 22 bp, Homo sapiens
tcttcttgggtgtgaccagtct

SEQ ID NO: 557864 - DNA, 22 bp, Homo sapiens
gctttggtgaaatgtcaccggc

SEQ ID NO: 557865 - DNA, 22 bp, Homo sapiens
taaaaattaatagcatcattgc

SEQ ID NO: 557866 - DNA, 22 bp, Homo sapiens
agggcctcaatgactcagtccc

SEQ ID NO: 557867 - DNA, 22 bp, Homo sapiens
cagatcaagggagatgtgccat

SEQ ID NO: 557868 - DNA, 22 bp, Homo sapiens
ttcacatttctctgacgtttga

SEQ ID NO: 557869 - DNA, 22 bp, Homo sapiens
aggtttggagcgggggaggcca

SEQ ID NO: 557870 - DNA, 22 bp, Homo sapiens
ctattcatttttaaaacccaga

SEQ ID NO: 557871 - DNA, 22 bp, Homo sapiens
aagatttccccccgcccccatt

SEQ ID NO: 557872 - DNA, 22 bp, Homo sapiens
tgcttgcctaggttacagtgaa

SEQ ID NO: 557873 - DNA, 22 bp, Homo sapiens
aggcatgtcatcttgtttggaa

SEQ ID NO: 557874 - DNA, 22 bp, Homo sapiens
gtattcagtgcaagtcaacgtc

SEQ ID NO: 557875 - DNA, 22 bp, Homo sapiens
tgaccagctaggaggagttgat

SEQ ID NO: 557876 - DNA, 22 bp, Homo sapiens
aggctttgcagctgctcttaga

SEQ ID NO: 557877 - DNA, 22 bp, Homo sapiens
gacctgaatggcttgccattat

SEQ ID NO: 557878 - DNA, 22 bp, Homo sapiens
tctgtgtgtgtgggatggggct

SEQ ID NO: 557879 - DNA, 22 bp, Homo sapiens
ctcctgtgattgcctcgcccag

SEQ ID NO: 557880 - DNA, 22 bp, Homo sapiens
tgtgcaatggtgtcaccacatg

SEQ ID NO: 557881 - DNA, 22 bp, Homo sapiens
ctgtctcggcccagccagtatg

SEQ ID NO: 557882 - DNA, 22 bp, Homo sapiens
ccaactgctgtcactgcatgct

SEQ ID NO: 557883 - DNA, 22 bp, Homo sapiens
tagaactctatggctttgacgt

SEQ ID NO: 557884 - DNA, 22 bp, Homo sapiens
tgggtggaggggggatcaggag

SEQ ID NO: 557885 - DNA, 22 bp, Homo sapiens
tggcaggtgagagctctttgaa

SEQ ID NO: 557886 - DNA, 22 bp, Homo sapiens
tggggtggggaggtggtctggg

SEQ ID NO: 557887 - DNA, 22 bp, Homo sapiens
gatatgcacatgtacacatgca

SEQ ID NO: 557888 - DNA, 22 bp, Homo sapiens
cctcatgttcagggaagaccag

SEQ ID NO: 557889 - DNA, 22 bp, Homo sapiens
tcccccttttactgcctttttc

SEQ ID NO: 557890 - DNA, 22 bp, Homo sapiens
tgaagtttatgcttttcgggtc

SEQ ID NO: 557891 - DNA, 22 bp, Homo sapiens
tgggtggaacatgtttcatgct

SEQ ID NO: 557892 - DNA, 22 bp, Homo sapiens
agaatgatagttgttaaaaata

SEQ ID NO: 557893 - DNA, 22 bp, Homo sapiens
tcataaagatggcgattgtata

SEQ ID NO: 557894 - DNA, 22 bp, Homo sapiens
gacattagagctaagtttttag

SEQ ID NO: 557895 - DNA, 22 bp, Homo sapiens
ggagccgctgctgtggaatgac

SEQ ID NO: 557896 - DNA, 22 bp, Homo sapiens
tctctcatctttttatatttca

SEQ ID NO: 557897 - DNA, 22 bp, Homo sapiens
ggctttcctgagggtgtggcgg

SEQ ID NO: 557898 - DNA, 22 bp, Homo sapiens
taaatgcagtctgtgctgggct

SEQ ID NO: 557899 - DNA, 22 bp, Homo sapiens
tagtgatttggtggagctcagt

SEQ ID NO: 557900 - DNA, 22 bp, Homo sapiens
gggggccgtgggtgcctgtcaa

SEQ ID NO: 557901 - DNA, 22 bp, Homo sapiens
actcccagcaggccacgcgccg

SEQ ID NO: 557902 - DNA, 22 bp, Homo sapiens
gaatggtgtgctttttactggg

SEQ ID NO: 557903 - DNA, 22 bp, Homo sapiens
tcccagcttagtattattttta

SEQ ID NO: 557904 - DNA, 22 bp, Homo sapiens
tttgggttagtaggatgatcct

SEQ ID NO: 557905 - DNA, 22 bp, Homo sapiens
ttgcttctttcttgtcttggat

SEQ ID NO: 557906 - DNA, 22 bp, Homo sapiens
ccccagtgcagggcctggcacg

SEQ ID NO: 557907 - DNA, 22 bp, Homo sapiens
tcaggactgggtcattctgttc

SEQ ID NO: 557908 - DNA, 22 bp, Homo sapiens
tttttgcatcttgggcattgct

SEQ ID NO: 557909 - DNA, 22 bp, Homo sapiens
accagttgtggttggggttgga

SEQ ID NO: 557910 - DNA, 22 bp, Homo sapiens
tttctgcatgcactgggtgtca

SEQ ID NO: 557911 - DNA, 22 bp, Homo sapiens
tccagctattaatgtttttgct

SEQ ID NO: 557912 - DNA, 22 bp, Homo sapiens
tgcttcctccccttagaaagtc

SEQ ID NO: 557913 - DNA, 22 bp, Homo sapiens
aaatgttaattccattgttgga

SEQ ID NO: 557914 - DNA, 22 bp, Homo sapiens
ctaggatcccccaagccccttc

SEQ ID NO: 557915 - DNA, 22 bp, Homo sapiens
tcctgcggcccctgccttgccg

SEQ ID NO: 557916 - DNA, 22 bp, Homo sapiens
tttcttgctagggtgctttctt

SEQ ID NO: 557917 - DNA, 22 bp, Homo sapiens
tctgcctcttgggtagtggtag

SEQ ID NO: 557918 - DNA, 22 bp, Homo sapiens
tggcatgcctcaaagggactgg

SEQ ID NO: 557919 - DNA, 22 bp, Homo sapiens
ttttttccaatagtgaatatgc

SEQ ID NO: 557920 - DNA, 22 bp, Homo sapiens
ttttggttgggtgttttctccc

SEQ ID NO: 557921 - DNA, 22 bp, Homo sapiens
ctggacgatggggttgaggcct

SEQ ID NO: 557922 - DNA, 22 bp, Homo sapiens
tccactctcatggaatttccat

SEQ ID NO: 557923 - DNA, 22 bp, Homo sapiens
cagcctggttgcaatgctgctg

SEQ ID NO: 557924 - DNA, 22 bp, Homo sapiens
tgctgtgatcaggagtgacccc

SEQ ID NO: 557925 - DNA, 22 bp, Homo sapiens
aatcttaaggaatgtcaccttg

SEQ ID NO: 557926 - DNA, 22 bp, Homo sapiens
tgaagggcaaggagccagtgga

SEQ ID NO: 557927 - DNA, 22 bp, Homo sapiens
ctagctgccaccttccctcctc

SEQ ID NO: 557928 - DNA, 22 bp, Homo sapiens
tctacctcctgcccttcccacc

SEQ ID NO: 557929 - DNA, 22 bp, Homo sapiens
taaccctcaaacaattcacata

SEQ ID NO: 557930 - DNA, 22 bp, Homo sapiens
tctaggagagtgtgaaccctgt

SEQ ID NO: 557931 - DNA, 22 bp, Homo sapiens
tcaatgtctccaagagcgttga

SEQ ID NO: 557932 - DNA, 22 bp, Homo sapiens
aggctgagactctgaatttttc

SEQ ID NO: 557933 - DNA, 22 bp, Homo sapiens
tcccagcccatgctctgtgcct

SEQ ID NO: 557934 - DNA, 22 bp, Homo sapiens
tttgcctctccatcctcagatg

SEQ ID NO: 557935 - DNA, 22 bp, Homo sapiens
agagccaggttgacttgctccc

SEQ ID NO: 557936 - DNA, 22 bp, Homo sapiens
gcgaatttatgttagaacacat

SEQ ID NO: 557937 - DNA, 22 bp, Homo sapiens
aagggggatggtggtggtgagg

SEQ ID NO: 557938 - DNA, 22 bp, Homo sapiens
ttggctgaatgaactgccccct

SEQ ID NO: 557939 - DNA, 22 bp, Homo sapiens
tgaactctaccaaatcacaaat

SEQ ID NO: 557940 - DNA, 22 bp, Homo sapiens
tctgctctccatctccgtgaca

SEQ ID NO: 557941 - DNA, 22 bp, Homo sapiens
tttcaccttctgactgttctgt

SEQ ID NO: 557942 - DNA, 22 bp, Homo sapiens
catgatttataaggcaggaggg

SEQ ID NO: 557943 - DNA, 22 bp, Homo sapiens
acatttgccttgcctttagtgc

SEQ ID NO: 557944 - DNA, 22 bp, Homo sapiens
tgcctgacctctatttcttggg

SEQ ID NO: 557945 - DNA, 22 bp, Homo sapiens
ctgttcagcctctttccttgcc

SEQ ID NO: 557946 - DNA, 22 bp, Homo sapiens
tgcaacgaacctgagccactga

SEQ ID NO: 557947 - DNA, 22 bp, Homo sapiens
tggacacctcaggatgcttcct

SEQ ID NO: 557948 - DNA, 22 bp, Homo sapiens
tcccagaatggggagagtgcag

SEQ ID NO: 557949 - DNA, 22 bp, Homo sapiens
tggtcagggcccctgagttcca

SEQ ID NO: 557950 - DNA, 22 bp, Homo sapiens
acgtccaggaagcggtcagtat

SEQ ID NO: 557951 - DNA, 22 bp, Homo sapiens
agaaaaggggaagaaagccagg

SEQ ID NO: 557952 - DNA, 22 bp, Homo sapiens
gcttgtccgtattccctcttct

SEQ ID NO: 557953 - DNA, 22 bp, Homo sapiens
gcttctctagcttgtgaatctg

SEQ ID NO: 557954 - DNA, 22 bp, Homo sapiens
gaggccaatgacagtcagaggt

SEQ ID NO: 557955 - DNA, 22 bp, Homo sapiens
tgcaaatggcagttttgttatt

SEQ ID NO: 557956 - DNA, 22 bp, Homo sapiens
cctgtagatctgtgcctctcac

SEQ ID NO: 557957 - DNA, 22 bp, Homo sapiens
tggaggagccagcggctggcta

SEQ ID NO: 557958 - DNA, 22 bp, Homo sapiens
aatggtttccaaggggtatgct

SEQ ID NO: 557959 - DNA, 22 bp, Homo sapiens
tagaggacatacaaatgaggga

SEQ ID NO: 557960 - DNA, 22 bp, Homo sapiens
tgagtgaagttctgaactttcc

SEQ ID NO: 557961 - DNA, 22 bp, Homo sapiens
acatctggaagttgggtgacag

SEQ ID NO: 557962 - DNA, 22 bp, Homo sapiens
tgggctggccatttcaacttcc

SEQ ID NO: 557963 - DNA, 22 bp, Homo sapiens
gataggcttaattttcctgtca

SEQ ID NO: 557964 - DNA, 22 bp, Homo sapiens
tctgggttaaagatagtttttg

SEQ ID NO: 557965 - DNA, 22 bp, Homo sapiens
tcccctgtgtagccggcagcag

SEQ ID NO: 557966 - DNA, 22 bp, Homo sapiens
tcagtaggcattgaagaccagc

SEQ ID NO: 557967 - DNA, 22 bp, Homo sapiens
tgggcctaagcttgtgtctaca

SEQ ID NO: 557968 - DNA, 22 bp, Homo sapiens
gttcgaatcaatcataccctct

SEQ ID NO: 557969 - DNA, 22 bp, Homo sapiens
catggttttaaggtcactgccg

SEQ ID NO: 557970 - DNA, 22 bp, Homo sapiens
gagatgataaaaagttttgtat

SEQ ID NO: 557971 - DNA, 22 bp, Homo sapiens
tcataaatagataaaattaact

SEQ ID NO: 557972 - DNA, 22 bp, Homo sapiens
ttgctgaatgctgtgtctccaa

SEQ ID NO: 557973 - DNA, 22 bp, Homo sapiens
cacatcatcagctgtgtctgca

SEQ ID NO: 557974 - DNA, 22 bp, Homo sapiens
ttatcttggaacttggtatggg

SEQ ID NO: 557975 - DNA, 22 bp, Homo sapiens
taggggacaccatactcatgtt

SEQ ID NO: 557976 - DNA, 22 bp, Homo sapiens
tcagtgagccatctgtgctcag

SEQ ID NO: 557977 - DNA, 22 bp, Homo sapiens
aaagaaaattggcctccatgga

SEQ ID NO: 557978 - DNA, 22 bp, Homo sapiens
gtaaggcacccttctgagtaga

SEQ ID NO: 557979 - DNA, 22 bp, Homo sapiens
tgcacctccagcggctggtgag

SEQ ID NO: 557980 - DNA, 22 bp, Homo sapiens
taatctactagtctgtttgtta

SEQ ID NO: 557981 - DNA, 22 bp, Homo sapiens
tggccacaaatcagagaaatgt

SEQ ID NO: 557982 - DNA, 22 bp, Homo sapiens
cttcctcggtggcggaggggcc

SEQ ID NO: 557983 - DNA, 22 bp, Homo sapiens
gggggatgagggaggggccaga

SEQ ID NO: 557984 - DNA, 22 bp, Homo sapiens
tccagctcctgcctgcctctgc

SEQ ID NO: 557985 - DNA, 22 bp, Homo sapiens
ttgtgagaggggagacttggca

SEQ ID NO: 557986 - DNA, 22 bp, Homo sapiens
agactttggcttcttgggcaaa

SEQ ID NO: 557987 - DNA, 22 bp, Homo sapiens
aggtgacttgatgactaccact

SEQ ID NO: 557988 - DNA, 22 bp, Homo sapiens
cgacccctgccccagcgtgtgt

SEQ ID NO: 557989 - DNA, 22 bp, Homo sapiens
agcgcgctttctgcctcgctgg

SEQ ID NO: 557990 - DNA, 22 bp, Homo sapiens
ttgatgatcagtggacatggca

SEQ ID NO: 557991 - DNA, 22 bp, Homo sapiens
tcaggtaaatgccaatcaggag

SEQ ID NO: 557992 - DNA, 22 bp, Homo sapiens
cttgtacatgagcaataattgt

SEQ ID NO: 557993 - DNA, 22 bp, Homo sapiens
acaatgtaagagacatgtgaaa

SEQ ID NO: 557994 - DNA, 22 bp, Homo sapiens
ctggctttgcagcttgtctagt

SEQ ID NO: 557995 - DNA, 22 bp, Homo sapiens
tgaggaacataactcagataaa

SEQ ID NO: 557996 - DNA, 22 bp, Homo sapiens
aatacagtttgatacataatag

SEQ ID NO: 557997 - DNA, 22 bp, Homo sapiens
cgcccctcccccaccggcccgg

SEQ ID NO: 557998 - DNA, 22 bp, Homo sapiens
attccagtccccactgtgtcct

SEQ ID NO: 557999 - DNA, 22 bp, Homo sapiens
ggcagtggaagctgtctgaggc

SEQ ID NO: 558000 - DNA, 22 bp, Homo sapiens
tcctctccccgtctccatggcc

SEQ ID NO: 558001 - DNA, 22 bp, Homo sapiens
ggaagggggtgcctgagtgcca

SEQ ID NO: 558002 - DNA, 22 bp, Homo sapiens
gtgcaggcctgtgtgggtcagg

SEQ ID NO: 558003 - DNA, 22 bp, Homo sapiens
gccctagctgctggtgggcaca

SEQ ID NO: 558004 - DNA, 22 bp, Homo sapiens
tcaaagagcacagggtgagagc

SEQ ID NO: 558005 - DNA, 22 bp, Homo sapiens
caattggcagcaagtcaggatg

SEQ ID NO: 558006 - DNA, 22 bp, Homo sapiens
tggctgaccctggggagctagc

SEQ ID NO: 558007 - DNA, 22 bp, Homo sapiens
catctggatatccttcctcagc

SEQ ID NO: 558008 - DNA, 22 bp, Homo sapiens
ggggaaggagaaagtgaaggga

SEQ ID NO: 558009 - DNA, 22 bp, Homo sapiens
ccttcactcatcctcacggagg

SEQ ID NO: 558010 - DNA, 22 bp, Homo sapiens
taatcagcccataaaatctatt

SEQ ID NO: 558011 - DNA, 22 bp, Homo sapiens
atcattttaaatggctctataa

SEQ ID NO: 558012 - DNA, 22 bp, Homo sapiens
tcacactcccagagctgaggct

SEQ ID NO: 558013 - DNA, 22 bp, Homo sapiens
agtcaggaattgattttggata

SEQ ID NO: 558014 - DNA, 22 bp, Homo sapiens
ggagagggaggtggcggggagc

SEQ ID NO: 558015 - DNA, 22 bp, Homo sapiens
tttacctgatagattaggatgg

SEQ ID NO: 558016 - DNA, 22 bp, Homo sapiens
tggaattcaaacataattttga

SEQ ID NO: 558017 - DNA, 22 bp, Homo sapiens
tagagtgattggagggattgga

SEQ ID NO: 558018 - DNA, 22 bp, Homo sapiens
gaagaggtgtaggaagaaaggt

SEQ ID NO: 558019 - DNA, 22 bp, Homo sapiens
tctccggggcccccaggcctgg

SEQ ID NO: 558020 - DNA, 22 bp, Homo sapiens
tgggaggcagaagattttgttt

SEQ ID NO: 558021 - DNA, 22 bp, Homo sapiens
tactacagggcaacccttttcc

SEQ ID NO: 558022 - DNA, 22 bp, Homo sapiens
gccttaatttgacaaggctttc

SEQ ID NO: 558023 - DNA, 22 bp, Homo sapiens
tacctgactctgaccaacctct

SEQ ID NO: 558024 - DNA, 22 bp, Homo sapiens
acacagaggaacactgacttgc

SEQ ID NO: 558025 - DNA, 22 bp, Homo sapiens
gtgtgatttattctgggattta

SEQ ID NO: 558026 - DNA, 22 bp, Homo sapiens
agcctgcagctgagcctcgagt

SEQ ID NO: 558027 - DNA, 22 bp, Homo sapiens
attgcttgaaaccaggtcatga

SEQ ID NO: 558028 - DNA, 22 bp, Homo sapiens
acacatgggaatggggccgggg

SEQ ID NO: 558029 - DNA, 22 bp, Homo sapiens
tctccagcttggtgctggctct

SEQ ID NO: 558030 - DNA, 22 bp, Homo sapiens
actcaatagtaccttagtggcc

SEQ ID NO: 558031 - DNA, 22 bp, Homo sapiens
tcatcagactggctcagtttct

SEQ ID NO: 558032 - DNA, 22 bp, Homo sapiens
ggccttggctgcatcctgggca

SEQ ID NO: 558033 - DNA, 22 bp, Homo sapiens
ctgcacccaaggagttggtgac

SEQ ID NO: 558034 - DNA, 22 bp, Homo sapiens
gtctgatgatatcttgcttgat

SEQ ID NO: 558035 - DNA, 22 bp, Homo sapiens
tttttgtattatttttggcttg

SEQ ID NO: 558036 - DNA, 22 bp, Homo sapiens
aaggcagagaggcttggctctg

SEQ ID NO: 558037 - DNA, 22 bp, Homo sapiens
aagaatcttgatttgtttgaga

SEQ ID NO: 558038 - DNA, 22 bp, Homo sapiens
tgggtctaggtgctgtgggagg

SEQ ID NO: 558039 - DNA, 22 bp, Homo sapiens
taagtggtccaggatttgttct

SEQ ID NO: 558040 - DNA, 22 bp, Homo sapiens
tgaaagggttgagaatagactt

SEQ ID NO: 558041 - DNA, 22 bp, Homo sapiens
attagtgtgggatgatcatgac

SEQ ID NO: 558042 - DNA, 22 bp, Homo sapiens
aaaggtgctcagcctctagccc

SEQ ID NO: 558043 - DNA, 22 bp, Homo sapiens
ttgtttccatggtgacagcagc

SEQ ID NO: 558044 - DNA, 22 bp, Homo sapiens
tttttgcaataatgctagcaga

SEQ ID NO: 558045 - DNA, 22 bp, Homo sapiens
attcttggtccctgcattgaga

SEQ ID NO: 558046 - DNA, 22 bp, Homo sapiens
gagtcaccagaaaccctcaatg

SEQ ID NO: 558047 - DNA, 22 bp, Homo sapiens
tagaacaggaagagggataagg

SEQ ID NO: 558048 - DNA, 22 bp, Homo sapiens
taataagatggcaggaggcaga

SEQ ID NO: 558049 - DNA, 22 bp, Homo sapiens
cctatggtcttttgttttctgg

SEQ ID NO: 558050 - DNA, 22 bp, Homo sapiens
tcatcttcagaggagacccaga

SEQ ID NO: 558051 - DNA, 22 bp, Homo sapiens
tgagatctgggctgccttcccc

SEQ ID NO: 558052 - DNA, 22 bp, Homo sapiens
acaaattagagcctatcttatc

SEQ ID NO: 558053 - DNA, 22 bp, Homo sapiens
tccacggtcccttctggcccta

SEQ ID NO: 558054 - DNA, 22 bp, Homo sapiens
tgggtctggaggaaggagaggc

SEQ ID NO: 558055 - DNA, 22 bp, Homo sapiens
tgtggtctctaggctgactctt

SEQ ID NO: 558056 - DNA, 22 bp, Homo sapiens
agaaataggtcattaacagtag

SEQ ID NO: 558057 - DNA, 22 bp, Homo sapiens
gccctcctttctgtctcaggct

SEQ ID NO: 558058 - DNA, 22 bp, Homo sapiens
ttagcattactatttataaaga

SEQ ID NO: 558059 - DNA, 22 bp, Homo sapiens
tccccaggaatttcctgggctg

SEQ ID NO: 558060 - DNA, 22 bp, Homo sapiens
acaaagccaagacttaaataga

SEQ ID NO: 558061 - DNA, 22 bp, Homo sapiens
ttatcacagaagcaaatgaaaa

SEQ ID NO: 558062 - DNA, 22 bp, Homo sapiens
gggtgttctgccctgtgtaccc

SEQ ID NO: 558063 - DNA, 22 bp, Homo sapiens
cccagttttgcttgatgttggg

SEQ ID NO: 558064 - DNA, 22 bp, Homo sapiens
agtaacagaaaggctcaggtgc

SEQ ID NO: 558065 - DNA, 22 bp, Homo sapiens
tgaccaatgacattgaagagct

SEQ ID NO: 558066 - DNA, 22 bp, Homo sapiens
tgcccattagtttttccattag

SEQ ID NO: 558067 - DNA, 22 bp, Homo sapiens
tgtattgtagattgaataataa

SEQ ID NO: 558068 - DNA, 22 bp, Homo sapiens
ccacaaacatgtccctttgaga

SEQ ID NO: 558069 - DNA, 22 bp, Homo sapiens
tcagtgagggatccggtctgtc

SEQ ID NO: 558070 - DNA, 22 bp, Homo sapiens
ttctgcaagtgaggaatgcctg

SEQ ID NO: 558071 - DNA, 22 bp, Homo sapiens
cctgttttcatcctacttttaa

SEQ ID NO: 558072 - DNA, 22 bp, Homo sapiens
aaggaattttatttgaggaact

SEQ ID NO: 558073 - DNA, 22 bp, Homo sapiens
tggggtaggagggtaagtctta

SEQ ID NO: 558074 - DNA, 22 bp, Homo sapiens
tgagggaaactcattcatactc

SEQ ID NO: 558075 - DNA, 22 bp, Homo sapiens
agcttcttggcctgctcagcag

SEQ ID NO: 558076 - DNA, 22 bp, Homo sapiens
ttttgtggagtttgtaaatttg

SEQ ID NO: 558077 - DNA, 22 bp, Homo sapiens
tttaaagaggaaacagaccaaa

SEQ ID NO: 558078 - DNA, 22 bp, Homo sapiens
tcacatctaaggatgaagacta

SEQ ID NO: 558079 - DNA, 22 bp, Homo sapiens
aggaaatttacctcttctaaac

SEQ ID NO: 558080 - DNA, 22 bp, Homo sapiens
ttcctcatcctcctgaggcctg

SEQ ID NO: 558081 - DNA, 22 bp, Homo sapiens
ccagtcatgtgctgttattttt

SEQ ID NO: 558082 - DNA, 22 bp, Homo sapiens
aatggtcactagggaaggggcg

SEQ ID NO: 558083 - DNA, 22 bp, Homo sapiens
gcagagggtaggacggggaaag

SEQ ID NO: 558084 - DNA, 22 bp, Homo sapiens
cataatgacaataatcattaac

SEQ ID NO: 558085 - DNA, 22 bp, Homo sapiens
gctgcttggcactaccagcatt

SEQ ID NO: 558086 - DNA, 22 bp, Homo sapiens
cgctgggggtcatcctatctct

SEQ ID NO: 558087 - DNA, 22 bp, Homo sapiens
ctctgcatccgaacccgccacc

SEQ ID NO: 558088 - DNA, 22 bp, Homo sapiens
tggacagtatttagtattctat

SEQ ID NO: 558089 - DNA, 22 bp, Homo sapiens
tgggtctgtgctcttggcctgc

SEQ ID NO: 558090 - DNA, 22 bp, Homo sapiens
ttagaggaaatctgttgctggg

SEQ ID NO: 558091 - DNA, 22 bp, Homo sapiens
gaatgtcaggctctgtcacctt

SEQ ID NO: 558092 - DNA, 22 bp, Homo sapiens
tttctagttcagtggtgctaga

SEQ ID NO: 558093 - DNA, 22 bp, Homo sapiens
cgtgccacttgatagctctgtc

SEQ ID NO: 558094 - DNA, 22 bp, Homo sapiens
tgagacatgattaacttgcaat

SEQ ID NO: 558095 - DNA, 22 bp, Homo sapiens
gtcagaccacagctttcctttt

SEQ ID NO: 558096 - DNA, 22 bp, Homo sapiens
ccacgatacagtgggaggcaca

SEQ ID NO: 558097 - DNA, 22 bp, Homo sapiens
gaacgggtgtgttctgtcagac

SEQ ID NO: 558098 - DNA, 22 bp, Homo sapiens
tccatgtcctatgtgttactgt

SEQ ID NO: 558099 - DNA, 22 bp, Homo sapiens
tggtgattgaagagcagatgtt

SEQ ID NO: 558100 - DNA, 22 bp, Homo sapiens
cagccctgtgaggtgtttctgt

SEQ ID NO: 558101 - DNA, 22 bp, Homo sapiens
aaccaaggatgcccagctggcc

SEQ ID NO: 558102 - DNA, 22 bp, Homo sapiens
ttgaggcctccaggatgtagtc

SEQ ID NO: 558103 - DNA, 22 bp, Homo sapiens
tatttgttgagtaaatgaatca

SEQ ID NO: 558104 - DNA, 22 bp, Homo sapiens
agagattaggctgggggcttta

SEQ ID NO: 558105 - DNA, 22 bp, Homo sapiens
tggttttcctggatgaggcatt

SEQ ID NO: 558106 - DNA, 22 bp, Homo sapiens
ggctctaagtgtggcccatgag

SEQ ID NO: 558107 - DNA, 22 bp, Homo sapiens
accctggcctgtggagccaggc

SEQ ID NO: 558108 - DNA, 22 bp, Homo sapiens
tggcaggttccgagatgaggag

SEQ ID NO: 558109 - DNA, 22 bp, Homo sapiens
taattgtggggaagaatgccgt

SEQ ID NO: 558110 - DNA, 22 bp, Homo sapiens
taagtcaagtgaagacctgact

SEQ ID NO: 558111 - DNA, 22 bp, Homo sapiens
aaagaaaggtagcctatggttg

SEQ ID NO: 558112 - DNA, 22 bp, Homo sapiens
ggtcctggggtaagagaggatc

SEQ ID NO: 558113 - DNA, 22 bp, Homo sapiens
aaatgggaacaccaccacctgg

SEQ ID NO: 558114 - DNA, 22 bp, Homo sapiens
ggttttgatgttttgtcattca

SEQ ID NO: 558115 - DNA, 22 bp, Homo sapiens
tgggcccagccttcctgcccct

SEQ ID NO: 558116 - DNA, 22 bp, Homo sapiens
tgagggagctgacctttctgtg

SEQ ID NO: 558117 - DNA, 22 bp, Homo sapiens
ccggccaatcgctgcgttggga

SEQ ID NO: 558118 - DNA, 22 bp, Homo sapiens
tctcccctgagctgacagcagg

SEQ ID NO: 558119 - DNA, 22 bp, Homo sapiens
caccagcctctggggaggggag

SEQ ID NO: 558120 - DNA, 22 bp, Homo sapiens
caggctcagtgtgactcctcca

SEQ ID NO: 558121 - DNA, 22 bp, Homo sapiens
tttccttcagaaagttcaagtc

SEQ ID NO: 558122 - DNA, 22 bp, Homo sapiens
taaaactaagtaccttgaaggg

SEQ ID NO: 558123 - DNA, 22 bp, Homo sapiens
tatttatggaaaactggcattt

SEQ ID NO: 558124 - DNA, 22 bp, Homo sapiens
tggagcacatttaggaataggg

SEQ ID NO: 558125 - DNA, 22 bp, Homo sapiens
tccaacatagaaactttctata

SEQ ID NO: 558126 - DNA, 22 bp, Homo sapiens
tgaccaggggatttttgtgtag

SEQ ID NO: 558127 - DNA, 22 bp, Homo sapiens
tgcagcaggtgctcactaaaca

SEQ ID NO: 558128 - DNA, 22 bp, Homo sapiens
cagagttggacaacaaccaagg

SEQ ID NO: 558129 - DNA, 22 bp, Homo sapiens
ttctctgccaagtggtctgaga

SEQ ID NO: 558130 - DNA, 22 bp, Homo sapiens
tgggggcagagaggaggaattt

SEQ ID NO: 558131 - DNA, 22 bp, Homo sapiens
tacagaaagtattggtagtttc

SEQ ID NO: 558132 - DNA, 22 bp, Homo sapiens
tctaaggcccctctcttagtca

SEQ ID NO: 558133 - DNA, 22 bp, Homo sapiens
atatgacaacatcttgcagaaa

SEQ ID NO: 558134 - DNA, 22 bp, Homo sapiens
taacattatacagagaggacag

SEQ ID NO: 558135 - DNA, 22 bp, Homo sapiens
tcaaataagaaccacacagagg

SEQ ID NO: 558136 - DNA, 22 bp, Homo sapiens
gctcgcgcccggagccctgccc

SEQ ID NO: 558137 - DNA, 22 bp, Homo sapiens
tagggaatgatacataaaccat

SEQ ID NO: 558138 - DNA, 22 bp, Homo sapiens
tctgtctctggcagggcagagg

SEQ ID NO: 558139 - DNA, 22 bp, Homo sapiens
tgcttgcatatttaaggtgggg

SEQ ID NO: 558140 - DNA, 22 bp, Homo sapiens
ctgtgtgtttctgtcggagtgt

SEQ ID NO: 558141 - DNA, 22 bp, Homo sapiens
aggtctgcgagctctgctgggt

SEQ ID NO: 558142 - DNA, 22 bp, Homo sapiens
tggactttaataaaagggaaat

SEQ ID NO: 558143 - DNA, 22 bp, Homo sapiens
ccctaacttctaaaaagtctgt

SEQ ID NO: 558144 - DNA, 22 bp, Homo sapiens
ggcttcctggagcaggtgtggg

SEQ ID NO: 558145 - DNA, 22 bp, Homo sapiens
tctccaattggcatacttttaa

SEQ ID NO: 558146 - DNA, 22 bp, Homo sapiens
agcctggtaattttcagtcaag

SEQ ID NO: 558147 - DNA, 22 bp, Homo sapiens
taaacttgcatccatgtggctt

SEQ ID NO: 558148 - DNA, 22 bp, Homo sapiens
tgtcctgttgttgttcataaac

SEQ ID NO: 558149 - DNA, 22 bp, Homo sapiens
gggagtctgtgctgctgagccc

SEQ ID NO: 558150 - DNA, 22 bp, Homo sapiens
tttgaaagaatttatgtacttt

SEQ ID NO: 558151 - DNA, 22 bp, Homo sapiens
tgcatgtttagtgacacaatcc

SEQ ID NO: 558152 - DNA, 22 bp, Homo sapiens
tcacaaagactgatccaaagtc

SEQ ID NO: 558153 - DNA, 22 bp, Homo sapiens
cctctgtttgtgtttcagatgg

SEQ ID NO: 558154 - DNA, 22 bp, Homo sapiens
cacataagtcctccagtaggtc

SEQ ID NO: 558155 - DNA, 22 bp, Homo sapiens
ctagtaagactaagacactaag

SEQ ID NO: 558156 - DNA, 22 bp, Homo sapiens
ccctggcattgcccctacgggt

SEQ ID NO: 558157 - DNA, 22 bp, Homo sapiens
gggaagaacctaaaggagatga

SEQ ID NO: 558158 - DNA, 22 bp, Homo sapiens
aaggactgggctgggttattat

SEQ ID NO: 558159 - DNA, 22 bp, Homo sapiens
gatgtcctgaggcagaggatat

SEQ ID NO: 558160 - DNA, 22 bp, Homo sapiens
tgaggctggagcctgtgtcccc

SEQ ID NO: 558161 - DNA, 22 bp, Homo sapiens
tgaataccatcctcacaaggga

SEQ ID NO: 558162 - DNA, 22 bp, Homo sapiens
ctttaaaatatgccactgaagc

SEQ ID NO: 558163 - DNA, 22 bp, Homo sapiens
tctgggcggcagggtggggaat

SEQ ID NO: 558164 - DNA, 22 bp, Homo sapiens
ttcaaggataagtcatatgtca

SEQ ID NO: 558165 - DNA, 22 bp, Homo sapiens
ggaaggaaggaacagtcatggg

SEQ ID NO: 558166 - DNA, 22 bp, Homo sapiens
tcgcggcgcaaggcggggtcgc

SEQ ID NO: 558167 - DNA, 22 bp, Homo sapiens
taggaggagggaggggcgacat

SEQ ID NO: 558168 - DNA, 22 bp, Homo sapiens
tggtgtggtgggggtgggcagt

SEQ ID NO: 558169 - DNA, 22 bp, Homo sapiens
ttccatttttcctgacagtcat

SEQ ID NO: 558170 - DNA, 22 bp, Homo sapiens
tgtcacttaagggtggtgtctc

SEQ ID NO: 558171 - DNA, 22 bp, Homo sapiens
tggggacaccgcaggaagtact

SEQ ID NO: 558172 - DNA, 22 bp, Homo sapiens
ttgtatcactaaacatgtgaca

SEQ ID NO: 558173 - DNA, 22 bp, Homo sapiens
gccacacaaatgtaaggcatta

SEQ ID NO: 558174 - DNA, 22 bp, Homo sapiens
tatagcagttttaggagatctg

SEQ ID NO: 558175 - DNA, 22 bp, Homo sapiens
ccccagggggttttgggggctg

SEQ ID NO: 558176 - DNA, 22 bp, Homo sapiens
cctcactgacttgtactgtcca

SEQ ID NO: 558177 - DNA, 22 bp, Homo sapiens
tatgctataaagactaataatt

SEQ ID NO: 558178 - DNA, 22 bp, Homo sapiens
catcgcagcagtgctttgatag

SEQ ID NO: 558179 - DNA, 22 bp, Homo sapiens
gacaatatgactattccattta

SEQ ID NO: 558180 - DNA, 22 bp, Homo sapiens
tgcctcttgggaggagaggcct

SEQ ID NO: 558181 - DNA, 22 bp, Homo sapiens
tctcaagggcagtccctcccag

SEQ ID NO: 558182 - DNA, 22 bp, Homo sapiens
tttgtgctgccagtggaaagcc

SEQ ID NO: 558183 - DNA, 22 bp, Homo sapiens
tcgctgttgctacctctcctcg

SEQ ID NO: 558184 - DNA, 22 bp, Homo sapiens
tgtttcagatgtatttgatagg

SEQ ID NO: 558185 - DNA, 22 bp, Homo sapiens
atcaggggtaggtgtttaggat

SEQ ID NO: 558186 - DNA, 22 bp, Homo sapiens
ggtaaggttactgtcacacagt

SEQ ID NO: 558187 - DNA, 22 bp, Homo sapiens
tcctacaatgcaggttaaatct

SEQ ID NO: 558188 - DNA, 22 bp, Homo sapiens
tagactacgctcacactagacc

SEQ ID NO: 558189 - DNA, 22 bp, Homo sapiens
tattaggttggggcgaaagtaa

SEQ ID NO: 558190 - DNA, 22 bp, Homo sapiens
tcaggcacagacaatgagtgtg

SEQ ID NO: 558191 - DNA, 22 bp, Homo sapiens
tggctgtatatattttgcatat

SEQ ID NO: 558192 - DNA, 22 bp, Homo sapiens
tgtgttttctcgctatttatca

SEQ ID NO: 558193 - DNA, 22 bp, Homo sapiens
ttagtgaagggcagcagggact

SEQ ID NO: 558194 - DNA, 22 bp, Homo sapiens
caagcttgggatgagattcctt

SEQ ID NO: 558195 - DNA, 22 bp, Homo sapiens
cactcatcaactgtgcctgaca

SEQ ID NO: 558196 - DNA, 22 bp, Homo sapiens
gatcccgggatcaaatcgggtg

SEQ ID NO: 558197 - DNA, 22 bp, Homo sapiens
tactccacctgtatctaaaaag

SEQ ID NO: 558198 - DNA, 22 bp, Homo sapiens
cctgcctggccctgtgcaggtg

SEQ ID NO: 558199 - DNA, 22 bp, Homo sapiens
agctgatggtggtgctgaccat

SEQ ID NO: 558200 - DNA, 22 bp, Homo sapiens
tgcaagtgagtcattttacttg

SEQ ID NO: 558201 - DNA, 22 bp, Homo sapiens
ggaaaaatgtcaggatgggaaa

SEQ ID NO: 558202 - DNA, 22 bp, Homo sapiens
accagaaattgttatatataca

SEQ ID NO: 558203 - DNA, 22 bp, Homo sapiens
taacaagttgaaaaaaaactaa

SEQ ID NO: 558204 - DNA, 22 bp, Homo sapiens
tctctgtatctgggtgctgcaa

SEQ ID NO: 558205 - DNA, 22 bp, Homo sapiens
cagcctcctggtctttgagcct

SEQ ID NO: 558206 - DNA, 22 bp, Homo sapiens
tgattccactctttccacagac

SEQ ID NO: 558207 - DNA, 22 bp, Homo sapiens
tccgtctcccgcttgcagtagg

SEQ ID NO: 558208 - DNA, 22 bp, Homo sapiens
agtgatatataatgcatggtcc

SEQ ID NO: 558209 - DNA, 22 bp, Homo sapiens
ctgtctgttagagttatagtgt

SEQ ID NO: 558210 - DNA, 22 bp, Homo sapiens
gcttggcagggcttgtgatgcg

SEQ ID NO: 558211 - DNA, 22 bp, Homo sapiens
caaacatttggttttgagttca

SEQ ID NO: 558212 - DNA, 22 bp, Homo sapiens
tcttggcagcctcagtttcccc

SEQ ID NO: 558213 - DNA, 22 bp, Homo sapiens
tggggttttcatagaggatgat

SEQ ID NO: 558214 - DNA, 22 bp, Homo sapiens
ggggtgggggcgctccatgcag

SEQ ID NO: 558215 - DNA, 22 bp, Homo sapiens
tttgtgtttccctgcagaggga

SEQ ID NO: 558216 - DNA, 22 bp, Homo sapiens
tgaccccaaatgcccttgggac

SEQ ID NO: 558217 - DNA, 22 bp, Homo sapiens
tctgctccaggacaggggcccc

SEQ ID NO: 558218 - DNA, 22 bp, Homo sapiens
ttttttgatttccctttgatag

SEQ ID NO: 558219 - DNA, 22 bp, Homo sapiens
taccagagtattgaaatggaaa

SEQ ID NO: 558220 - DNA, 22 bp, Homo sapiens
gccctacctccggcccttgcga

SEQ ID NO: 558221 - DNA, 22 bp, Homo sapiens
tggaatacaaaggatctctagt

SEQ ID NO: 558222 - DNA, 22 bp, Homo sapiens
cctctctccctggggtgcagaa

SEQ ID NO: 558223 - DNA, 22 bp, Homo sapiens
ggtcattgtggagaggcactta

SEQ ID NO: 558224 - DNA, 22 bp, Homo sapiens
tgcctctgtggtcacagcttca

SEQ ID NO: 558225 - DNA, 22 bp, Homo sapiens
tgtgtcccaactgtagctgggg

SEQ ID NO: 558226 - DNA, 22 bp, Homo sapiens
agggaggaggttggggtgaagg

SEQ ID NO: 558227 - DNA, 22 bp, Homo sapiens
tcaaaagtgactccagcatctg

SEQ ID NO: 558228 - DNA, 22 bp, Homo sapiens
acccagacaagtatggggaatc

SEQ ID NO: 558229 - DNA, 22 bp, Homo sapiens
tggtggggtcacggtccttcag

SEQ ID NO: 558230 - DNA, 22 bp, Homo sapiens
ccacttcctgctcctccctccc

SEQ ID NO: 558231 - DNA, 22 bp, Homo sapiens
actttctgagggagattgaaaa

SEQ ID NO: 558232 - DNA, 22 bp, Homo sapiens
tgcttccagttggctaatgttc

SEQ ID NO: 558233 - DNA, 22 bp, Homo sapiens
ccctttcctggatttcttgtca

SEQ ID NO: 558234 - DNA, 22 bp, Homo sapiens
gccttgctgacattgtgactct

SEQ ID NO: 558235 - DNA, 22 bp, Homo sapiens
ggggtccccggtgctcggatct

SEQ ID NO: 558236 - DNA, 22 bp, Homo sapiens
acaaatgtagcatttgtagatt

SEQ ID NO: 558237 - DNA, 22 bp, Homo sapiens
gctttgtcccaggctttctggt

SEQ ID NO: 558238 - DNA, 22 bp, Homo sapiens
ctagatggggcttcagggggca

SEQ ID NO: 558239 - DNA, 22 bp, Homo sapiens
ttgggagagggaagggatttct

SEQ ID NO: 558240 - DNA, 22 bp, Homo sapiens
gtggcacatgtttgttgtgagg

SEQ ID NO: 558241 - DNA, 22 bp, Homo sapiens
tggaaggagccagcatgccaga

SEQ ID NO: 558242 - DNA, 22 bp, Homo sapiens
cccctgatgggcctcgggactc

SEQ ID NO: 558243 - DNA, 22 bp, Homo sapiens
taatcatgcaaccactagaaaa

SEQ ID NO: 558244 - DNA, 22 bp, Homo sapiens
tgagttaaaaaggggggtgtca

SEQ ID NO: 558245 - DNA, 22 bp, Homo sapiens
taagctaatcaggactccagtc

SEQ ID NO: 558246 - DNA, 22 bp, Homo sapiens
tgaaagggtttcatttatggcc

SEQ ID NO: 558247 - DNA, 22 bp, Homo sapiens
ctgcttgttgtggactgtctaa

SEQ ID NO: 558248 - DNA, 22 bp, Homo sapiens
taaagagatggagagaggccat

SEQ ID NO: 558249 - DNA, 22 bp, Homo sapiens
ctgagattgcgttccttacaca

SEQ ID NO: 558250 - DNA, 22 bp, Homo sapiens
tggaaaggtcagagattggaat

SEQ ID NO: 558251 - DNA, 22 bp, Homo sapiens
ttattttctgccatttaccttc

SEQ ID NO: 558252 - DNA, 22 bp, Homo sapiens
gcattgtgtttttgaatggagc

SEQ ID NO: 558253 - DNA, 22 bp, Homo sapiens
cagggacaactccattcgtaga

SEQ ID NO: 558254 - DNA, 22 bp, Homo sapiens
tgccgctgggtctgaggacctg

SEQ ID NO: 558255 - DNA, 22 bp, Homo sapiens
cctgctggcccaggccccttgc

SEQ ID NO: 558256 - DNA, 22 bp, Homo sapiens
tgcaaggagggcattggctgtt

SEQ ID NO: 558257 - DNA, 22 bp, Homo sapiens
tcgtcatctatgatttccatct

SEQ ID NO: 558258 - DNA, 22 bp, Homo sapiens
ctgctgggctttctgggacgac

SEQ ID NO: 558259 - DNA, 22 bp, Homo sapiens
gggctgggctgggctgggtggg

SEQ ID NO: 558260 - DNA, 22 bp, Homo sapiens
ggcttcagattgcttaatgctc

SEQ ID NO: 558261 - DNA, 22 bp, Homo sapiens
tgaggatgtgtgattcttttga

SEQ ID NO: 558262 - DNA, 22 bp, Homo sapiens
ctgcagaatgatgagaatacag

SEQ ID NO: 558263 - DNA, 22 bp, Homo sapiens
tgagggtaggtggggtggctgc

SEQ ID NO: 558264 - DNA, 22 bp, Homo sapiens
cagggacaggtaaacgcaggaa

SEQ ID NO: 558265 - DNA, 22 bp, Homo sapiens
tggctggttggggttaatgtct

SEQ ID NO: 558266 - DNA, 22 bp, Homo sapiens
tggccttgggtcagagagggct

SEQ ID NO: 558267 - DNA, 22 bp, Homo sapiens
gatagagctgggtctgtctgcc

SEQ ID NO: 558268 - DNA, 22 bp, Homo sapiens
tcaaaaaaaatgatgcaggcat

SEQ ID NO: 558269 - DNA, 22 bp, Homo sapiens
tagtgaaatattgaggcagcaa

SEQ ID NO: 558270 - DNA, 22 bp, Homo sapiens
taagatggatgaaataaccata

SEQ ID NO: 558271 - DNA, 22 bp, Homo sapiens
taggttaaatgctaagtatttt

SEQ ID NO: 558272 - DNA, 22 bp, Homo sapiens
tctacagtgcctggtcaccaac

SEQ ID NO: 558273 - DNA, 22 bp, Homo sapiens
aaataacttgctgggttcggca

SEQ ID NO: 558274 - DNA, 22 bp, Homo sapiens
gactgcagccagtttaaatatg

SEQ ID NO: 558275 - DNA, 22 bp, Homo sapiens
atggcaggaatcatgtgttttg

SEQ ID NO: 558276 - DNA, 22 bp, Homo sapiens
ccacacgcgcaggggccaggct

SEQ ID NO: 558277 - DNA, 22 bp, Homo sapiens
tcttcccgaggtcccagctgac

SEQ ID NO: 558278 - DNA, 22 bp, Homo sapiens
cctgttgagcaactggccatcc

SEQ ID NO: 558279 - DNA, 22 bp, Homo sapiens
tttagtttgcccacagcatgag

SEQ ID NO: 558280 - DNA, 22 bp, Homo sapiens
ttatggcagccaggatattgtc

SEQ ID NO: 558281 - DNA, 22 bp, Homo sapiens
gcggggctcgcgctgggaaact

SEQ ID NO: 558282 - DNA, 22 bp, Homo sapiens
gccgggaccgcgaccccgcccc

SEQ ID NO: 558283 - DNA, 22 bp, Homo sapiens
aaggtgaccagatctccagtaa

SEQ ID NO: 558284 - DNA, 22 bp, Homo sapiens
tcacactgcacatttctagata

SEQ ID NO: 558285 - DNA, 22 bp, Homo sapiens
aggggtgcaagaggccagtggc

SEQ ID NO: 558286 - DNA, 22 bp, Homo sapiens
tgataggagggtaggaggcaaa

SEQ ID NO: 558287 - DNA, 22 bp, Homo sapiens
tgtttccaggagttttgccaca

SEQ ID NO: 558288 - DNA, 22 bp, Homo sapiens
aggattcaggagcagcctccca

SEQ ID NO: 558289 - DNA, 22 bp, Homo sapiens
tccttactgaggtcccaaactg

SEQ ID NO: 558290 - DNA, 22 bp, Homo sapiens
aggcgggctgtgcagatgttat

SEQ ID NO: 558291 - DNA, 22 bp, Homo sapiens
agcatcctcaggagccagtgcc

SEQ ID NO: 558292 - DNA, 22 bp, Homo sapiens
tccatttccctgcctcctgcac

SEQ ID NO: 558293 - DNA, 22 bp, Homo sapiens
ggtcagaggtttttcaggttct

SEQ ID NO: 558294 - DNA, 22 bp, Homo sapiens
cccacttctacttctgttatcg

SEQ ID NO: 558295 - DNA, 22 bp, Homo sapiens
gccggctctaccatggggcctt

SEQ ID NO: 558296 - DNA, 22 bp, Homo sapiens
tcagatgtgtccacagctaatt

SEQ ID NO: 558297 - DNA, 22 bp, Homo sapiens
tttgtatcatctgtgggctctg

SEQ ID NO: 558298 - DNA, 22 bp, Homo sapiens
acagtgactggaggtcaatgaa

SEQ ID NO: 558299 - DNA, 22 bp, Homo sapiens
tttccctctgcagcccaaaata

SEQ ID NO: 558300 - DNA, 22 bp, Homo sapiens
tacaggagcaggtgggacccca

SEQ ID NO: 558301 - DNA, 22 bp, Homo sapiens
tcagatgatgtcttcagggaat

SEQ ID NO: 558302 - DNA, 22 bp, Homo sapiens
tgcataacaccaacatttttcc

SEQ ID NO: 558303 - DNA, 22 bp, Homo sapiens
ttagccaagttttgtggctttt

SEQ ID NO: 558304 - DNA, 22 bp, Homo sapiens
ttatagtctaaaggtcaatgct

SEQ ID NO: 558305 - DNA, 22 bp, Homo sapiens
tgtgggtgtcaggcagtgagct

SEQ ID NO: 558306 - DNA, 22 bp, Homo sapiens
tcttctgttggcccctcatgtt

SEQ ID NO: 558307 - DNA, 22 bp, Homo sapiens
tccactggctgccatgacccca

SEQ ID NO: 558308 - DNA, 22 bp, Homo sapiens
tggactgtgctgccacagtggg

SEQ ID NO: 558309 - DNA, 22 bp, Homo sapiens
cagagctaggattgcttttttt

SEQ ID NO: 558310 - DNA, 22 bp, Homo sapiens
tctgatgacatctcagccttcg

SEQ ID NO: 558311 - DNA, 22 bp, Homo sapiens
gagggttgaggattggaacttg

SEQ ID NO: 558312 - DNA, 22 bp, Homo sapiens
caacatgcctgctggtcaggcc

SEQ ID NO: 558313 - DNA, 22 bp, Homo sapiens
tctctgcctggggataatttct

SEQ ID NO: 558314 - DNA, 22 bp, Homo sapiens
agcctgcatttgtctctctatc

SEQ ID NO: 558315 - DNA, 22 bp, Homo sapiens
tagagaatggaaagaggcaggg

SEQ ID NO: 558316 - DNA, 22 bp, Homo sapiens
cctgtgctgggaactaggggta

SEQ ID NO: 558317 - DNA, 22 bp, Homo sapiens
tattcagagtgtaagagctaga

SEQ ID NO: 558318 - DNA, 22 bp, Homo sapiens
gtctgatggcttcctctggccg

SEQ ID NO: 558319 - DNA, 22 bp, Homo sapiens
gggcagggctgggggccgggac

SEQ ID NO: 558320 - DNA, 22 bp, Homo sapiens
ccccccgccaccttcttttccc

SEQ ID NO: 558321 - DNA, 22 bp, Homo sapiens
taaaagggcttggcaaatgctg

SEQ ID NO: 558322 - DNA, 22 bp, Homo sapiens
gctggaagatgaagaggagaga

SEQ ID NO: 558323 - DNA, 22 bp, Homo sapiens
tttatggtcctttcctgcctta

SEQ ID NO: 558324 - DNA, 22 bp, Homo sapiens
tggaaggctgaggttcaaaggc

SEQ ID NO: 558325 - DNA, 22 bp, Homo sapiens
tccaataggtggttctaggctt

SEQ ID NO: 558326 - DNA, 22 bp, Homo sapiens
ggagagtgaatgggtgaaagag

SEQ ID NO: 558327 - DNA, 22 bp, Homo sapiens
ttcctgatgacttctctctctc

SEQ ID NO: 558328 - DNA, 22 bp, Homo sapiens
gatgtgtatcatatatatgtat

SEQ ID NO: 558329 - DNA, 22 bp, Homo sapiens
ttttgtcaccatggcaactggt

SEQ ID NO: 558330 - DNA, 22 bp, Homo sapiens
agtcagagacagacctagggga

SEQ ID NO: 558331 - DNA, 22 bp, Homo sapiens
gccccgggtagctgggaagggc

SEQ ID NO: 558332 - DNA, 22 bp, Homo sapiens
gactcactgccaggagcctggg

SEQ ID NO: 558333 - DNA, 22 bp, Homo sapiens
gctgtggaggggttgggggtgc

SEQ ID NO: 558334 - DNA, 22 bp, Homo sapiens
tgtatgtatagcatcttctaac

SEQ ID NO: 558335 - DNA, 22 bp, Homo sapiens
tttgaaaggtgcttagaacatt

SEQ ID NO: 558336 - DNA, 22 bp, Homo sapiens
agcgaaacaggcaaacggagaa

SEQ ID NO: 558337 - DNA, 22 bp, Homo sapiens
tagtagtatcattgaaatgaca

SEQ ID NO: 558338 - DNA, 22 bp, Homo sapiens
gattctgaggattctacaaagc

SEQ ID NO: 558339 - DNA, 22 bp, Homo sapiens
tgctggaatgtgacgttggcat

SEQ ID NO: 558340 - DNA, 22 bp, Homo sapiens
gaaacacaagagcaaggtgctg

SEQ ID NO: 558341 - DNA, 22 bp, Homo sapiens
tgcctcatgtgctgtgctggga

SEQ ID NO: 558342 - DNA, 22 bp, Homo sapiens
tctggaagtactgttagctcag

SEQ ID NO: 558343 - DNA, 22 bp, Homo sapiens
tgtcatggggtactacacatgg

SEQ ID NO: 558344 - DNA, 22 bp, Homo sapiens
tggaaaagcattaagatcattt

SEQ ID NO: 558345 - DNA, 22 bp, Homo sapiens
tctctgaccagaggatctgtct

SEQ ID NO: 558346 - DNA, 22 bp, Homo sapiens
tttagtctttgctcccagaatt

SEQ ID NO: 558347 - DNA, 22 bp, Homo sapiens
tgtctcagaggtcctgggggtg

SEQ ID NO: 558348 - DNA, 22 bp, Homo sapiens
tccaagtgtggacagagctcat

SEQ ID NO: 558349 - DNA, 22 bp, Homo sapiens
actgagggcatgggggatgagt

SEQ ID NO: 558350 - DNA, 22 bp, Homo sapiens
atcaattcactgctgcagcctt

SEQ ID NO: 558351 - DNA, 22 bp, Homo sapiens
tgattcacccagtctaagctac

SEQ ID NO: 558352 - DNA, 22 bp, Homo sapiens
acctagaaccatgtctgacgca

SEQ ID NO: 558353 - DNA, 22 bp, Homo sapiens
tttctttgcttcccatcttctc

SEQ ID NO: 558354 - DNA, 22 bp, Homo sapiens
tgctctctctcaggacttccat

SEQ ID NO: 558355 - DNA, 22 bp, Homo sapiens
ttatcttgctcttctctaatcc

SEQ ID NO: 558356 - DNA, 22 bp, Homo sapiens
gtgggttgttttgactttttat

SEQ ID NO: 558357 - DNA, 22 bp, Homo sapiens
gttttgcattcacgtttgcact

SEQ ID NO: 558358 - DNA, 22 bp, Homo sapiens
agctttggggtcagacagactg

SEQ ID NO: 558359 - DNA, 22 bp, Homo sapiens
catggccttgggccgcctggag

SEQ ID NO: 558360 - DNA, 22 bp, Homo sapiens
gcagttcagggtcttgttagct

SEQ ID NO: 558361 - DNA, 22 bp, Homo sapiens
tgttcagatcccttaggtaccc

SEQ ID NO: 558362 - DNA, 22 bp, Homo sapiens
agaggccaggactggactcaga

SEQ ID NO: 558363 - DNA, 22 bp, Homo sapiens
tggtatgcctcgtttccagtaa

SEQ ID NO: 558364 - DNA, 22 bp, Homo sapiens
gccttccctgctgagagctgct

SEQ ID NO: 558365 - DNA, 22 bp, Homo sapiens
actcatgccaagaaatgatcct

SEQ ID NO: 558366 - DNA, 22 bp, Homo sapiens
cttcccctccttccctttcccc

SEQ ID NO: 558367 - DNA, 22 bp, Homo sapiens
gagggagcgtgtgcatgtgcac

SEQ ID NO: 558368 - DNA, 22 bp, Homo sapiens
cttgggtttaatcctatccatc

SEQ ID NO: 558369 - DNA, 22 bp, Homo sapiens
caggaacatagggcgacaccca

SEQ ID NO: 558370 - DNA, 22 bp, Homo sapiens
tcagtgagtctgggggtgtgtg

SEQ ID NO: 558371 - DNA, 22 bp, Homo sapiens
gagcaatacatggcatgaaatt

SEQ ID NO: 558372 - DNA, 22 bp, Homo sapiens
ggagggggagttagagaggagg

SEQ ID NO: 558373 - DNA, 22 bp, Homo sapiens
tagagttgggggaactctggca

SEQ ID NO: 558374 - DNA, 22 bp, Homo sapiens
taaggtggaacacgtgacctag

SEQ ID NO: 558375 - DNA, 22 bp, Homo sapiens
gccctctcccaagccacctacc

SEQ ID NO: 558376 - DNA, 22 bp, Homo sapiens
aaggttttcatgtctctcttct

SEQ ID NO: 558377 - DNA, 22 bp, Homo sapiens
gagcaagtctacagaggctctc

SEQ ID NO: 558378 - DNA, 22 bp, Homo sapiens
tcctattttgctggggagagct

SEQ ID NO: 558379 - DNA, 22 bp, Homo sapiens
tccagctgttcacctcagctct

SEQ ID NO: 558380 - DNA, 22 bp, Homo sapiens
tactcctgggtggaccagatag

SEQ ID NO: 558381 - DNA, 22 bp, Homo sapiens
gaaaggaggcgcaccttacaag

SEQ ID NO: 558382 - DNA, 22 bp, Homo sapiens
agcttgctcctctcgtcgtgca

SEQ ID NO: 558383 - DNA, 22 bp, Homo sapiens
tgtacttttcctagtttcagga

SEQ ID NO: 558384 - DNA, 22 bp, Homo sapiens
gcacacagctccctctagccct

SEQ ID NO: 558385 - DNA, 22 bp, Homo sapiens
ccctaagcctggctctatcctg

SEQ ID NO: 558386 - DNA, 22 bp, Homo sapiens
tgtcactcggctcggcccacta

SEQ ID NO: 558387 - DNA, 22 bp, Homo sapiens
taaaaaggcttacctccagcag

SEQ ID NO: 558388 - DNA, 22 bp, Homo sapiens
agtccctttaactcacagcccc

SEQ ID NO: 558389 - DNA, 22 bp, Homo sapiens
ggcctaatttcatttgattgaa

SEQ ID NO: 558390 - DNA, 22 bp, Homo sapiens
caaacatatggtggaaataatc

SEQ ID NO: 558391 - DNA, 22 bp, Homo sapiens
tgacccttctcaacattatatc

SEQ ID NO: 558392 - DNA, 22 bp, Homo sapiens
gctgttttcccgagtggtgggt

SEQ ID NO: 558393 - DNA, 22 bp, Homo sapiens
ttgtctcctctgtgtgtgtcct

SEQ ID NO: 558394 - DNA, 22 bp, Homo sapiens
tcatgaagagttctaacccttg

SEQ ID NO: 558395 - DNA, 22 bp, Homo sapiens
tgggcttggtaggtgtgggtgc

SEQ ID NO: 558396 - DNA, 22 bp, Homo sapiens
tggattaactggttccattgtc

SEQ ID NO: 558397 - DNA, 22 bp, Homo sapiens
tcagagagtcaagtattttttg

SEQ ID NO: 558398 - DNA, 22 bp, Homo sapiens
ttaccccctgctgctgacgtga

SEQ ID NO: 558399 - DNA, 22 bp, Homo sapiens
taggctgagctcagggttcagg

SEQ ID NO: 558400 - DNA, 22 bp, Homo sapiens
tgaggattgtcttttccactgc

SEQ ID NO: 558401 - DNA, 22 bp, Homo sapiens
cacatggtaggtattgagtatg

SEQ ID NO: 558402 - DNA, 22 bp, Homo sapiens
gacctccttcctgggaacaggt

SEQ ID NO: 558403 - DNA, 22 bp, Homo sapiens
ggtggcctcacccttccagttc

SEQ ID NO: 558404 - DNA, 22 bp, Homo sapiens
ccctgatttaattagcttttcc

SEQ ID NO: 558405 - DNA, 22 bp, Homo sapiens
tgtttctgcagagctggcctgg

SEQ ID NO: 558406 - DNA, 22 bp, Homo sapiens
caggcgtgcatgggtagaggct

SEQ ID NO: 558407 - DNA, 22 bp, Homo sapiens
aaagtgcatgaaaggaattaaa

SEQ ID NO: 558408 - DNA, 22 bp, Homo sapiens
tttccactgtaaattcaggctg

SEQ ID NO: 558409 - DNA, 22 bp, Homo sapiens
ttattccaggtgcttagcaatg

SEQ ID NO: 558410 - DNA, 22 bp, Homo sapiens
tctagtctgtatatgcctgtgt

SEQ ID NO: 558411 - DNA, 22 bp, Homo sapiens
ttctgggagcacaggctgaact

SEQ ID NO: 558412 - DNA, 22 bp, Homo sapiens
tgtcagtgctgttcttcagctg

SEQ ID NO: 558413 - DNA, 22 bp, Homo sapiens
cagcacccccatttctgctgct

SEQ ID NO: 558414 - DNA, 22 bp, Homo sapiens
ccatgtgcatattttaaacatt

SEQ ID NO: 558415 - DNA, 22 bp, Homo sapiens
ccaggtgaccctgaacctgctg

SEQ ID NO: 558416 - DNA, 22 bp, Homo sapiens
gactcttgcttttccctgtgca

SEQ ID NO: 558417 - DNA, 22 bp, Homo sapiens
gctgctgggctggaagctgtgc

SEQ ID NO: 558418 - DNA, 22 bp, Homo sapiens
agtggatgaggaaagcttccca

SEQ ID NO: 558419 - DNA, 22 bp, Homo sapiens
aaggggtgggggggaggggttg

SEQ ID NO: 558420 - DNA, 22 bp, Homo sapiens
cctggccatttcccccgattac

SEQ ID NO: 558421 - DNA, 22 bp, Homo sapiens
ggagacaggggcggggcggggg

SEQ ID NO: 558422 - DNA, 22 bp, Homo sapiens
gcagagcctaggccttggagtc

SEQ ID NO: 558423 - DNA, 22 bp, Homo sapiens
ttgaataaagccagctgtgagt

SEQ ID NO: 558424 - DNA, 22 bp, Homo sapiens
tcttttcctcactccttccttc

SEQ ID NO: 558425 - DNA, 22 bp, Homo sapiens
aacggccggtgacctcaccggg

SEQ ID NO: 558426 - DNA, 22 bp, Homo sapiens
actcaggagagtggcaatcaca

SEQ ID NO: 558427 - DNA, 22 bp, Homo sapiens
tatagctgtgtcactgtggcat

SEQ ID NO: 558428 - DNA, 22 bp, Homo sapiens
tctagttcttagacttcttgtc

SEQ ID NO: 558429 - DNA, 22 bp, Homo sapiens
ttacattttattgagaaatgtc

SEQ ID NO: 558430 - DNA, 22 bp, Homo sapiens
ggcctgggacagggtggaacac

SEQ ID NO: 558431 - DNA, 22 bp, Homo sapiens
cctaacttgaaagaggtgctaa

SEQ ID NO: 558432 - DNA, 22 bp, Homo sapiens
gttgcaataatacttaaggagt

SEQ ID NO: 558433 - DNA, 22 bp, Homo sapiens
atactgggttgagtataatttt

SEQ ID NO: 558434 - DNA, 22 bp, Homo sapiens
tttccctgggtctggagtgccc

SEQ ID NO: 558435 - DNA, 22 bp, Homo sapiens
agccagggccagtcctgagggt

SEQ ID NO: 558436 - DNA, 22 bp, Homo sapiens
tgttgttgattttttttccaaa

SEQ ID NO: 558437 - DNA, 22 bp, Homo sapiens
tctttggtaaagtctgctgcat

SEQ ID NO: 558438 - DNA, 22 bp, Homo sapiens
taagaggctaacacagaagggt

SEQ ID NO: 558439 - DNA, 22 bp, Homo sapiens
agacccaaggagcaagctgggg

SEQ ID NO: 558440 - DNA, 22 bp, Homo sapiens
ctgtgtggatgtgaagaatctg

SEQ ID NO: 558441 - DNA, 22 bp, Homo sapiens
attgctggcagtgacaggaagg

SEQ ID NO: 558442 - DNA, 22 bp, Homo sapiens
gggaggcaggaggggaggcttg

SEQ ID NO: 558443 - DNA, 22 bp, Homo sapiens
actgctgagtttaacactggga

SEQ ID NO: 558444 - DNA, 22 bp, Homo sapiens
gcaggtgcagggctgctgtatc

SEQ ID NO: 558445 - DNA, 22 bp, Homo sapiens
atgagcgggtgcctggcgtcga

SEQ ID NO: 558446 - DNA, 22 bp, Homo sapiens
tctctcaggcttggaggggcca

SEQ ID NO: 558447 - DNA, 22 bp, Homo sapiens
ttgatttttttccctgtggcct

SEQ ID NO: 558448 - DNA, 22 bp, Homo sapiens
tctggctgggagacaggcgccg

SEQ ID NO: 558449 - DNA, 22 bp, Homo sapiens
gtcaggatgcccaggccctgcc

SEQ ID NO: 558450 - DNA, 22 bp, Homo sapiens
tggagcttagggtcagtgaaga

SEQ ID NO: 558451 - DNA, 22 bp, Homo sapiens
tgcctgaaggtttagtctaaga

SEQ ID NO: 558452 - DNA, 22 bp, Homo sapiens
gagaaaaccaagttattgcctc

SEQ ID NO: 558453 - DNA, 22 bp, Homo sapiens
cttttttcccactcttggagga

SEQ ID NO: 558454 - DNA, 22 bp, Homo sapiens
ggatgcctgggtctcctccctc

SEQ ID NO: 558455 - DNA, 22 bp, Homo sapiens
aacacaggggcaggcagtggac

SEQ ID NO: 558456 - DNA, 22 bp, Homo sapiens
aagtgtatggtgtagctggtgt

SEQ ID NO: 558457 - DNA, 22 bp, Homo sapiens
tgccacaagacagaacaagctg

SEQ ID NO: 558458 - DNA, 22 bp, Homo sapiens
gactgggaaccgctatcctgtg

SEQ ID NO: 558459 - DNA, 22 bp, Homo sapiens
tccccctcccccaggtgccact

SEQ ID NO: 558460 - DNA, 22 bp, Homo sapiens
ttgacacaggcaggctctgggt

SEQ ID NO: 558461 - DNA, 22 bp, Homo sapiens
tgggggtgagatattttgcata

SEQ ID NO: 558462 - DNA, 22 bp, Homo sapiens
aaacaaacatggtgcacttctt

SEQ ID NO: 558463 - DNA, 22 bp, Homo sapiens
tgaagtgcttgctagtaggtag

SEQ ID NO: 558464 - DNA, 22 bp, Homo sapiens
caaatataggtaacaggctgta

SEQ ID NO: 558465 - DNA, 22 bp, Homo sapiens
gggggagttgggagtggagggt

SEQ ID NO: 558466 - DNA, 22 bp, Homo sapiens
tatagtaagtactcaataaagg

SEQ ID NO: 558467 - DNA, 22 bp, Homo sapiens
gtatttgatagtcctgcctgtg

SEQ ID NO: 558468 - DNA, 22 bp, Homo sapiens
tccctgctccaaggctgcagct

SEQ ID NO: 558469 - DNA, 22 bp, Homo sapiens
cagagtcccaggggagctgtgg

SEQ ID NO: 558470 - DNA, 22 bp, Homo sapiens
atgggatctctgcccctcagtt

SEQ ID NO: 558471 - DNA, 22 bp, Homo sapiens
ttcccaaattcatgtcactggg

SEQ ID NO: 558472 - DNA, 22 bp, Homo sapiens
tctattacctggatttaataaa

SEQ ID NO: 558473 - DNA, 22 bp, Homo sapiens
ttttctccccagacttgttggc

SEQ ID NO: 558474 - DNA, 22 bp, Homo sapiens
ttacataagacaagggaatata

SEQ ID NO: 558475 - DNA, 22 bp, Homo sapiens
tggctctgtgagttgatgacat

SEQ ID NO: 558476 - DNA, 22 bp, Homo sapiens
gattgatgctttcacagatcca

SEQ ID NO: 558477 - DNA, 22 bp, Homo sapiens
gccagtggaccctggggcagcc

SEQ ID NO: 558478 - DNA, 22 bp, Homo sapiens
taaagttgtttccaggctctgt

SEQ ID NO: 558479 - DNA, 22 bp, Homo sapiens
tcccattattactctgttttaa

SEQ ID NO: 558480 - DNA, 22 bp, Homo sapiens
ttctggggacactccctggtcc

SEQ ID NO: 558481 - DNA, 22 bp, Homo sapiens
ctgccctcgttgccctcagcaa

SEQ ID NO: 558482 - DNA, 22 bp, Homo sapiens
tgggagttgtagtctgccttgt

SEQ ID NO: 558483 - DNA, 22 bp, Homo sapiens
tgctgcttcatctatcctgtga

SEQ ID NO: 558484 - DNA, 22 bp, Homo sapiens
taaatagcaatgtttcctgagc

SEQ ID NO: 558485 - DNA, 22 bp, Homo sapiens
acggtggcctagattcttgccc

SEQ ID NO: 558486 - DNA, 22 bp, Homo sapiens
aggttcctgcctcctgacgtac

SEQ ID NO: 558487 - DNA, 22 bp, Homo sapiens
cgccggggctcagccccatctc

SEQ ID NO: 558488 - DNA, 22 bp, Homo sapiens
tagaccaggttgaccaggtagg

SEQ ID NO: 558489 - DNA, 22 bp, Homo sapiens
tgctgcagcatattgtactggc

SEQ ID NO: 558490 - DNA, 22 bp, Homo sapiens
tattctctttagtatctctgtg

SEQ ID NO: 558491 - DNA, 22 bp, Homo sapiens
tgcacactgggagttgtagtcc

SEQ ID NO: 558492 - DNA, 22 bp, Homo sapiens
tttctaaaggtcggcaaaactc

SEQ ID NO: 558493 - DNA, 22 bp, Homo sapiens
tggctccaccaaactcagggtg

SEQ ID NO: 558494 - DNA, 22 bp, Homo sapiens
gctcccggtgtcctgcaaacgt

SEQ ID NO: 558495 - DNA, 22 bp, Homo sapiens
tcccacctcctggggctggatg

SEQ ID NO: 558496 - DNA, 22 bp, Homo sapiens
agggttgtgacaagcttaatct

SEQ ID NO: 558497 - DNA, 22 bp, Homo sapiens
gcgggcttgctagctttcttga

SEQ ID NO: 558498 - DNA, 22 bp, Homo sapiens
tttggtatgtgttcctggaagg

SEQ ID NO: 558499 - DNA, 22 bp, Homo sapiens
ctgggtgtgctagaggctacaa

SEQ ID NO: 558500 - DNA, 22 bp, Homo sapiens
acctttgagcctctgctctctc

SEQ ID NO: 558501 - DNA, 22 bp, Homo sapiens
agactgactgcagtgtggtcat

SEQ ID NO: 558502 - DNA, 22 bp, Homo sapiens
agcaggctctggtgagactgtc

SEQ ID NO: 558503 - DNA, 22 bp, Homo sapiens
tgtgtgccatgtatgtgtgtga

SEQ ID NO: 558504 - DNA, 22 bp, Homo sapiens
tcagctgcaaataacactacct

SEQ ID NO: 558505 - DNA, 22 bp, Homo sapiens
acctccctcaggttcttccctg

SEQ ID NO: 558506 - DNA, 22 bp, Homo sapiens
cctcccagccagccattaattc

SEQ ID NO: 558507 - DNA, 22 bp, Homo sapiens
tatccctattaaaatgtgtgtg

SEQ ID NO: 558508 - DNA, 22 bp, Homo sapiens
gatgaaaccagggaagggcata

SEQ ID NO: 558509 - DNA, 22 bp, Homo sapiens
tgtttgccgtcattgccttgat

SEQ ID NO: 558510 - DNA, 22 bp, Homo sapiens
tccatgctttcagggtcactgt

SEQ ID NO: 558511 - DNA, 22 bp, Homo sapiens
tagtttcaaaactaattattct

SEQ ID NO: 558512 - DNA, 22 bp, Homo sapiens
tccctgggaattaatatttgga

SEQ ID NO: 558513 - DNA, 22 bp, Homo sapiens
ctggggctgggggcgggagagc

SEQ ID NO: 558514 - DNA, 22 bp, Homo sapiens
tagcacactcataatctttcat

SEQ ID NO: 558515 - DNA, 22 bp, Homo sapiens
tcacaaggaacgtctcctcttg

SEQ ID NO: 558516 - DNA, 22 bp, Homo sapiens
agccaggctccatgccacctct

SEQ ID NO: 558517 - DNA, 22 bp, Homo sapiens
gacataatgcagagagggacac

SEQ ID NO: 558518 - DNA, 22 bp, Homo sapiens
tgacaggtaaacacttgttttg

SEQ ID NO: 558519 - DNA, 22 bp, Homo sapiens
tacatgccttccagtaccattt

SEQ ID NO: 558520 - DNA, 22 bp, Homo sapiens
gcccctagggtatcatttagtt

SEQ ID NO: 558521 - DNA, 22 bp, Homo sapiens
gactgagattgtagacttggct

SEQ ID NO: 558522 - DNA, 22 bp, Homo sapiens
tgctccagtgtcttgctacgga

SEQ ID NO: 558523 - DNA, 22 bp, Homo sapiens
atactgagggtgagtctggggc

SEQ ID NO: 558524 - DNA, 22 bp, Homo sapiens
tgaataggtcaattcccctcac

SEQ ID NO: 558525 - DNA, 22 bp, Homo sapiens
acagtgccaggcagatgccagg

SEQ ID NO: 558526 - DNA, 22 bp, Homo sapiens
cactgtgcgtggagggaggtgg

SEQ ID NO: 558527 - DNA, 22 bp, Homo sapiens
tcttgattggcatttacctgag

SEQ ID NO: 558528 - DNA, 22 bp, Homo sapiens
cagcccctcccctccgcctcgc

SEQ ID NO: 558529 - DNA, 22 bp, Homo sapiens
atgttctggggttgtggactag

SEQ ID NO: 558530 - DNA, 22 bp, Homo sapiens
ccatgtattatagagaatagga

SEQ ID NO: 558531 - DNA, 22 bp, Homo sapiens
tggagaacatgacgctgggctc

SEQ ID NO: 558532 - DNA, 22 bp, Homo sapiens
taaattatttacagtgtgctcg

SEQ ID NO: 558533 - DNA, 22 bp, Homo sapiens
acctcagaaaagggacagaaag

SEQ ID NO: 558534 - DNA, 22 bp, Homo sapiens
cttgctgctgtacagcagctca

SEQ ID NO: 558535 - DNA, 22 bp, Homo sapiens
accttggacagacctgccaagt

SEQ ID NO: 558536 - DNA, 22 bp, Homo sapiens
gcattaactcctaaagtgtgga

SEQ ID NO: 558537 - DNA, 22 bp, Homo sapiens
catgatccagtgggctctcctg

SEQ ID NO: 558538 - DNA, 22 bp, Homo sapiens
cgcagggccttctgggagctgt

SEQ ID NO: 558539 - DNA, 22 bp, Homo sapiens
ttgcatggcgtccggagctgtc

SEQ ID NO: 558540 - DNA, 22 bp, Homo sapiens
caatgatgctattaatttttat

SEQ ID NO: 558541 - DNA, 22 bp, Homo sapiens
tttgcctccaaaagaggacagt

SEQ ID NO: 558542 - DNA, 22 bp, Homo sapiens
gcccgctgagcagccgaacgcg

SEQ ID NO: 558543 - DNA, 22 bp, Homo sapiens
aattatccagcttcagggacag

SEQ ID NO: 558544 - DNA, 22 bp, Homo sapiens
gagggacagcactgttgggaga

SEQ ID NO: 558545 - DNA, 22 bp, Homo sapiens
tctttcttcctttctgccctcc

SEQ ID NO: 558546 - DNA, 22 bp, Homo sapiens
tcagctacgcatgctattttca

SEQ ID NO: 558547 - DNA, 22 bp, Homo sapiens
ggctcttttagttgtccatgtc

SEQ ID NO: 558548 - DNA, 22 bp, Homo sapiens
tgagtaagacaggaatagagga

SEQ ID NO: 558549 - DNA, 22 bp, Homo sapiens
ccccatggcctttcccgcattc

SEQ ID NO: 558550 - DNA, 22 bp, Homo sapiens
gaggtgttggatggggctgctc

SEQ ID NO: 558551 - DNA, 22 bp, Homo sapiens
catcttctagtatctcttttta

SEQ ID NO: 558552 - DNA, 22 bp, Homo sapiens
cttgggttttctcctgtagttt

SEQ ID NO: 558553 - DNA, 22 bp, Homo sapiens
atgcaattctcttcttgcaaaa

SEQ ID NO: 558554 - DNA, 22 bp, Homo sapiens
ctttcaatggaatagccatgga

SEQ ID NO: 558555 - DNA, 22 bp, Homo sapiens
tcagttccaccagtacccagac

SEQ ID NO: 558556 - DNA, 22 bp, Homo sapiens
tctatcctcagcatcatgaaac

SEQ ID NO: 558557 - DNA, 22 bp, Homo sapiens
tagctcaatgggttattttcag

SEQ ID NO: 558558 - DNA, 22 bp, Homo sapiens
gggccagacctcttctcaggga

SEQ ID NO: 558559 - DNA, 22 bp, Homo sapiens
cgtgggggtgagctctgaggac

SEQ ID NO: 558560 - DNA, 22 bp, Homo sapiens
tagtttaacaaaagggaatcag

SEQ ID NO: 558561 - DNA, 22 bp, Homo sapiens
gcaggagaaagcgctatggtca

SEQ ID NO: 558562 - DNA, 22 bp, Homo sapiens
tggccatttcctcccctccaga

SEQ ID NO: 558563 - DNA, 22 bp, Homo sapiens
ctgggactcctccccactggac

SEQ ID NO: 558564 - DNA, 22 bp, Homo sapiens
tcctatttctgtcttggccagg

SEQ ID NO: 558565 - DNA, 22 bp, Homo sapiens
tctcaagggagggtgcaggcct

SEQ ID NO: 558566 - DNA, 22 bp, Homo sapiens
agaatcaaagcttctcccaagc

SEQ ID NO: 558567 - DNA, 22 bp, Homo sapiens
tcagaccttgacttatctactg

SEQ ID NO: 558568 - DNA, 22 bp, Homo sapiens
ttgaaagagaggagaggaagcc

SEQ ID NO: 558569 - DNA, 22 bp, Homo sapiens
ggatttttgcacagattctaga

SEQ ID NO: 558570 - DNA, 22 bp, Homo sapiens
tagacagattctgagttgagta

SEQ ID NO: 558571 - DNA, 22 bp, Homo sapiens
ttcaggtcttgagaagagtgtg

SEQ ID NO: 558572 - DNA, 22 bp, Homo sapiens
taacccatcacagacactgggt

SEQ ID NO: 558573 - DNA, 22 bp, Homo sapiens
gctaaattacaaactcagagga

SEQ ID NO: 558574 - DNA, 22 bp, Homo sapiens
tcagatgccacagagaacgaga

SEQ ID NO: 558575 - DNA, 22 bp, Homo sapiens
gactttgcatgaatctcattta

SEQ ID NO: 558576 - DNA, 22 bp, Homo sapiens
tgtccctggcttctccttctcc

SEQ ID NO: 558577 - DNA, 22 bp, Homo sapiens
tctgttgatatctgtaggttct

SEQ ID NO: 558578 - DNA, 22 bp, Homo sapiens
tgctgacatattctggaagctt

SEQ ID NO: 558579 - DNA, 22 bp, Homo sapiens
tgcccttggagatcataccagc

SEQ ID NO: 558580 - DNA, 22 bp, Homo sapiens
tgggagttctgacagggtcttc

SEQ ID NO: 558581 - DNA, 22 bp, Homo sapiens
aactaactgttaataaagtagg

SEQ ID NO: 558582 - DNA, 22 bp, Homo sapiens
ttatccagccttcaagttcagt

SEQ ID NO: 558583 - DNA, 22 bp, Homo sapiens
cacctgttacatccacgtgttg

SEQ ID NO: 558584 - DNA, 22 bp, Homo sapiens
tggaatgttgccagcagccaga

SEQ ID NO: 558585 - DNA, 22 bp, Homo sapiens
tctaaatcatttcaaaagcatc

SEQ ID NO: 558586 - DNA, 22 bp, Homo sapiens
aacttcatctagactccctggg

SEQ ID NO: 558587 - DNA, 22 bp, Homo sapiens
gctgggctggctcaggccctta

SEQ ID NO: 558588 - DNA, 22 bp, Homo sapiens
gcagttttcggtccccagggag

SEQ ID NO: 558589 - DNA, 22 bp, Homo sapiens
atgtctgcatgaatcacacagg

SEQ ID NO: 558590 - DNA, 22 bp, Homo sapiens
gaaatttgtggaatttactctc

SEQ ID NO: 558591 - DNA, 22 bp, Homo sapiens
agggcctggagggctgctggga

SEQ ID NO: 558592 - DNA, 22 bp, Homo sapiens
gggaataggagagagaagatgg

SEQ ID NO: 558593 - DNA, 22 bp, Homo sapiens
ggcattcgccggcgtcgtcatg

SEQ ID NO: 558594 - DNA, 22 bp, Homo sapiens
ccagccagggcccattgtcacc

SEQ ID NO: 558595 - DNA, 22 bp, Homo sapiens
aggtcagaggaggctggggcac

SEQ ID NO: 558596 - DNA, 22 bp, Homo sapiens
aagggccaggggcaggctggaa

SEQ ID NO: 558597 - DNA, 22 bp, Homo sapiens
cttggactctgacccttgcagt

SEQ ID NO: 558598 - DNA, 22 bp, Homo sapiens
tccatgatcagctgtatttggt

SEQ ID NO: 558599 - DNA, 22 bp, Homo sapiens
agatgctcagggctgtgacatt

SEQ ID NO: 558600 - DNA, 22 bp, Homo sapiens
cgcaagttcattcattgattca

SEQ ID NO: 558601 - DNA, 22 bp, Homo sapiens
tgcccatattctgtatggttaa

SEQ ID NO: 558602 - DNA, 22 bp, Homo sapiens
tctcttggtccccatcctgtca

SEQ ID NO: 558603 - DNA, 22 bp, Homo sapiens
tgggctgggggtggctggcagc

SEQ ID NO: 558604 - DNA, 22 bp, Homo sapiens
tacttcagaatctccaggagta

SEQ ID NO: 558605 - DNA, 22 bp, Homo sapiens
actagagggcaggaggccagag

SEQ ID NO: 558606 - DNA, 22 bp, Homo sapiens
cttcacctggtccactagccgt

SEQ ID NO: 558607 - DNA, 22 bp, Homo sapiens
actccaatgattttaaatcact

SEQ ID NO: 558608 - DNA, 22 bp, Homo sapiens
gagagatgagggcagaggagga

SEQ ID NO: 558609 - DNA, 22 bp, Homo sapiens
tcgttctcatgggccagagtca

SEQ ID NO: 558610 - DNA, 22 bp, Homo sapiens
tatttcacctatagatgtatgc

SEQ ID NO: 558611 - DNA, 22 bp, Homo sapiens
aaccaggactgtcagctaatta

SEQ ID NO: 558612 - DNA, 22 bp, Homo sapiens
gaaaactgtggctacattgtga

SEQ ID NO: 558613 - DNA, 22 bp, Homo sapiens
gcctaaagtgaatttttatggc

SEQ ID NO: 558614 - DNA, 22 bp, Homo sapiens
tatgccatggaatcacctccag

SEQ ID NO: 558615 - DNA, 22 bp, Homo sapiens
tgtgagtggactgcactatggt

SEQ ID NO: 558616 - DNA, 22 bp, Homo sapiens
tcttggtgccttctctcttagg

SEQ ID NO: 558617 - DNA, 22 bp, Homo sapiens
taaaaaggctaaataatgttac

SEQ ID NO: 558618 - DNA, 22 bp, Homo sapiens
tgctcttttatatgtgagaggc

SEQ ID NO: 558619 - DNA, 22 bp, Homo sapiens
ccatgtgttattttcttctctc

SEQ ID NO: 558620 - DNA, 22 bp, Homo sapiens
tacataaaatttctataactgt

SEQ ID NO: 558621 - DNA, 22 bp, Homo sapiens
ttaagctctggggaagaagcct

SEQ ID NO: 558622 - DNA, 22 bp, Homo sapiens
agttttcctttattgagtacca

SEQ ID NO: 558623 - DNA, 22 bp, Homo sapiens
ccggcttggggacagctccaga

SEQ ID NO: 558624 - DNA, 22 bp, Homo sapiens
ggtttataacttgaacaagagg

SEQ ID NO: 558625 - DNA, 22 bp, Homo sapiens
tttgagtaaacatccagtcact

SEQ ID NO: 558626 - DNA, 22 bp, Homo sapiens
catccttgccccggtacaatgt

SEQ ID NO: 558627 - DNA, 22 bp, Homo sapiens
taatccatagaaatccctgaga

SEQ ID NO: 558628 - DNA, 22 bp, Homo sapiens
cctagagacagggagtctggct

SEQ ID NO: 558629 - DNA, 22 bp, Homo sapiens
gggagctgaggggatcttgcaa

SEQ ID NO: 558630 - DNA, 22 bp, Homo sapiens
tcaagtggtcatttcactcttt

SEQ ID NO: 558631 - DNA, 22 bp, Homo sapiens
ggacttgggcgtcagtattctg

SEQ ID NO: 558632 - DNA, 22 bp, Homo sapiens
aaggaaggtaactgacagttgt

SEQ ID NO: 558633 - DNA, 22 bp, Homo sapiens
cattccttgggtgactggctgt

SEQ ID NO: 558634 - DNA, 22 bp, Homo sapiens
taggccattggtaataatggtg

SEQ ID NO: 558635 - DNA, 22 bp, Homo sapiens
taatgacatgccctggtagttt

SEQ ID NO: 558636 - DNA, 22 bp, Homo sapiens
aagctctgcacacttgtggaca

SEQ ID NO: 558637 - DNA, 22 bp, Homo sapiens
tagtcaaaatttatcttgaaag

SEQ ID NO: 558638 - DNA, 22 bp, Homo sapiens
gtccagcaaattgcttacgttc

SEQ ID NO: 558639 - DNA, 22 bp, Homo sapiens
ttgctaggggtgggcttgtctg

SEQ ID NO: 558640 - DNA, 22 bp, Homo sapiens
tggacttgaattggcactgagt

SEQ ID NO: 558641 - DNA, 22 bp, Homo sapiens
taggtggcctggagctttgtgg

SEQ ID NO: 558642 - DNA, 22 bp, Homo sapiens
tgggcacactgggatgaattgg

SEQ ID NO: 558643 - DNA, 22 bp, Homo sapiens
ccctggggcctgatttgcagca

SEQ ID NO: 558644 - DNA, 22 bp, Homo sapiens
ggttggctttccctgtgcacta

SEQ ID NO: 558645 - DNA, 22 bp, Homo sapiens
tagggagaggagccggctgtcc

SEQ ID NO: 558646 - DNA, 22 bp, Homo sapiens
taagatgtaatctcatttggaa

SEQ ID NO: 558647 - DNA, 22 bp, Homo sapiens
ttttatggcaatttgtttcatt

SEQ ID NO: 558648 - DNA, 22 bp, Homo sapiens
ggggtgtggtagataattaggt

SEQ ID NO: 558649 - DNA, 22 bp, Homo sapiens
tagggcctgctggtgcttccat

SEQ ID NO: 558650 - DNA, 22 bp, Homo sapiens
aggggccgtccctgtccccgct

SEQ ID NO: 558651 - DNA, 22 bp, Homo sapiens
tgggactggggggttgggggac

SEQ ID NO: 558652 - DNA, 22 bp, Homo sapiens
tcgtttttcctcaagtccatta

SEQ ID NO: 558653 - DNA, 22 bp, Homo sapiens
cctaggccctaggcttccatca

SEQ ID NO: 558654 - DNA, 22 bp, Homo sapiens
tcttcttcctgaagacagcagc

SEQ ID NO: 558655 - DNA, 22 bp, Homo sapiens
gctagacctgtttgttaagaaa

SEQ ID NO: 558656 - DNA, 22 bp, Homo sapiens
caaacagctgggtcggcagctg

SEQ ID NO: 558657 - DNA, 22 bp, Homo sapiens
actgatcaagttcctaatcctg

SEQ ID NO: 558658 - DNA, 22 bp, Homo sapiens
actgatattcagctggaatgta

SEQ ID NO: 558659 - DNA, 22 bp, Homo sapiens
ttattaggatagggaaagaggg

SEQ ID NO: 558660 - DNA, 22 bp, Homo sapiens
cagagttgggatgcgtgggagg

SEQ ID NO: 558661 - DNA, 22 bp, Homo sapiens
gcactcatctggctctgtctct

SEQ ID NO: 558662 - DNA, 22 bp, Homo sapiens
gacttttgggagagggtggaag

SEQ ID NO: 558663 - DNA, 22 bp, Homo sapiens
tcatcgccagccaaccacgacg

SEQ ID NO: 558664 - DNA, 22 bp, Homo sapiens
tgctgtcagcacagaccagatc

SEQ ID NO: 558665 - DNA, 22 bp, Homo sapiens
ggttcagtaaggggatgttgtc

SEQ ID NO: 558666 - DNA, 22 bp, Homo sapiens
gcagtagtttactgagtggact

SEQ ID NO: 558667 - DNA, 22 bp, Homo sapiens
agtttttgcactatatacctat

SEQ ID NO: 558668 - DNA, 22 bp, Homo sapiens
ctatccaagtataaggccattg

SEQ ID NO: 558669 - DNA, 22 bp, Homo sapiens
tctcaataggctctaactgtta

SEQ ID NO: 558670 - DNA, 22 bp, Homo sapiens
aatcccatagggttacacagga

SEQ ID NO: 558671 - DNA, 22 bp, Homo sapiens
cagcagggattttctagtctcc

SEQ ID NO: 558672 - DNA, 22 bp, Homo sapiens
ttttagggcattctgatcttca

SEQ ID NO: 558673 - DNA, 22 bp, Homo sapiens
tgtctcaggttttctcaggcca

SEQ ID NO: 558674 - DNA, 22 bp, Homo sapiens
cagtaaaggctttgaagttttg

SEQ ID NO: 558675 - DNA, 22 bp, Homo sapiens
tgcatcctatctcctgtgtgtt

SEQ ID NO: 558676 - DNA, 22 bp, Homo sapiens
ttagttaagtttggatgcatgg

SEQ ID NO: 558677 - DNA, 22 bp, Homo sapiens
actgattgatgaacttcagctt

SEQ ID NO: 558678 - DNA, 22 bp, Homo sapiens
atgggggtggggtggagcagaa

SEQ ID NO: 558679 - DNA, 22 bp, Homo sapiens
tcctgctcgcggcctctcccag

SEQ ID NO: 558680 - DNA, 22 bp, Homo sapiens
agtcaccatgaaggatggcctg

SEQ ID NO: 558681 - DNA, 22 bp, Homo sapiens
ccagatttgcattggcaaatgg

SEQ ID NO: 558682 - DNA, 22 bp, Homo sapiens
tgtttgctgggtgacagtcctt

SEQ ID NO: 558683 - DNA, 22 bp, Homo sapiens
tcatcagggtggtctttggaca

SEQ ID NO: 558684 - DNA, 22 bp, Homo sapiens
tgttttagctggcccattttga

SEQ ID NO: 558685 - DNA, 22 bp, Homo sapiens
tccacatatgcttagtttttgt

SEQ ID NO: 558686 - DNA, 22 bp, Homo sapiens
ggaggcccacaggcctggcccc

SEQ ID NO: 558687 - DNA, 22 bp, Homo sapiens
tagcaatcattagacatattag

SEQ ID NO: 558688 - DNA, 22 bp, Homo sapiens
tagtagagaaccttgctagaga

SEQ ID NO: 558689 - DNA, 22 bp, Homo sapiens
ccagggcagggaggctttctgg

SEQ ID NO: 558690 - DNA, 22 bp, Homo sapiens
gaggcagtgttgaaaaggagag

SEQ ID NO: 558691 - DNA, 22 bp, Homo sapiens
ctccctctgggtggggcagcag

SEQ ID NO: 558692 - DNA, 22 bp, Homo sapiens
ccattaactctagccagtcatt

SEQ ID NO: 558693 - DNA, 22 bp, Homo sapiens
cttcccctcctccccgttcccc

SEQ ID NO: 558694 - DNA, 22 bp, Homo sapiens
tcaatttcaatgcaacgctgca

SEQ ID NO: 558695 - DNA, 22 bp, Homo sapiens
cagtcattcttctcaccctcca

SEQ ID NO: 558696 - DNA, 22 bp, Homo sapiens
tctctcccctgcctgcctcctt

SEQ ID NO: 558697 - DNA, 22 bp, Homo sapiens
tcaggggcgggagtgtgcctta

SEQ ID NO: 558698 - DNA, 22 bp, Homo sapiens
tgaaactggagcgcctggagga

SEQ ID NO: 558699 - DNA, 22 bp, Homo sapiens
tggtttggctgacttagcctga

SEQ ID NO: 558700 - DNA, 22 bp, Homo sapiens
gagaaggggtcaaaggaaagca

SEQ ID NO: 558701 - DNA, 22 bp, Homo sapiens
acttattgcacagtttgttcag

SEQ ID NO: 558702 - DNA, 22 bp, Homo sapiens
ctctggcttagggtttagaagg

SEQ ID NO: 558703 - DNA, 22 bp, Homo sapiens
gaggggccactggatggtgtta

SEQ ID NO: 558704 - DNA, 22 bp, Homo sapiens
ttctggggatcacatgagggaa

SEQ ID NO: 558705 - DNA, 22 bp, Homo sapiens
ttacaggctctgaactaagtaa

SEQ ID NO: 558706 - DNA, 22 bp, Homo sapiens
ccatgcttggcttagcagagtc

SEQ ID NO: 558707 - DNA, 22 bp, Homo sapiens
gtggttgtggaggtgacagaac

SEQ ID NO: 558708 - DNA, 22 bp, Homo sapiens
ctcattttggccaaattgctat

SEQ ID NO: 558709 - DNA, 22 bp, Homo sapiens
tggctcacttcccaggcggtgg

SEQ ID NO: 558710 - DNA, 22 bp, Homo sapiens
tcctggacacgctgttggcctg

SEQ ID NO: 558711 - DNA, 22 bp, Homo sapiens
tgttcttgcactgcctgccaag

SEQ ID NO: 558712 - DNA, 22 bp, Homo sapiens
tgagttatgaggttatcaatca

SEQ ID NO: 558713 - DNA, 22 bp, Homo sapiens
ggccaccagggttccatttaga

SEQ ID NO: 558714 - DNA, 22 bp, Homo sapiens
tccttgctgccttaaactaacc

SEQ ID NO: 558715 - DNA, 22 bp, Homo sapiens
cgggttttggatctatttgatc

SEQ ID NO: 558716 - DNA, 22 bp, Homo sapiens
aataattgattaggggtcaccg

SEQ ID NO: 558717 - DNA, 22 bp, Homo sapiens
tataaggcctgggagggcaggg

SEQ ID NO: 558718 - DNA, 22 bp, Homo sapiens
ttttacccaataggcttaaatg

SEQ ID NO: 558719 - DNA, 22 bp, Homo sapiens
tcattatgctccatcttgtcag

SEQ ID NO: 558720 - DNA, 22 bp, Homo sapiens
tgttcttttagtaaaatgtggt

SEQ ID NO: 558721 - DNA, 22 bp, Homo sapiens
gcacatgaaggcgcccacacat

SEQ ID NO: 558722 - DNA, 22 bp, Homo sapiens
gcagggggtgaggtaatggcca

SEQ ID NO: 558723 - DNA, 22 bp, Homo sapiens
tgcaaggaatggctagggttac

SEQ ID NO: 558724 - DNA, 22 bp, Homo sapiens
gcgtcttaccagacatggttag

SEQ ID NO: 558725 - DNA, 22 bp, Homo sapiens
ctaggaaatctgtagaccacag

SEQ ID NO: 558726 - DNA, 22 bp, Homo sapiens
tgcatgcctgttaacctttaac

SEQ ID NO: 558727 - DNA, 22 bp, Homo sapiens
ccttgcttgcagcatatgcatt

SEQ ID NO: 558728 - DNA, 22 bp, Homo sapiens
agccagttccaaggtccacagg

SEQ ID NO: 558729 - DNA, 22 bp, Homo sapiens
gcacagggttatatcgccagta

SEQ ID NO: 558730 - DNA, 22 bp, Homo sapiens
ttggcagacaagcccataccct

SEQ ID NO: 558731 - DNA, 22 bp, Homo sapiens
ttcaaatgaagagttcagtgat

SEQ ID NO: 558732 - DNA, 22 bp, Homo sapiens
tggaggatggggttggcatgag

SEQ ID NO: 558733 - DNA, 22 bp, Homo sapiens
gggtctgatgttggccttagaa

SEQ ID NO: 558734 - DNA, 22 bp, Homo sapiens
tcatgttaccatgacaactgat

SEQ ID NO: 558735 - DNA, 22 bp, Homo sapiens
ctagacgcccagtaggtggatg

SEQ ID NO: 558736 - DNA, 22 bp, Homo sapiens
tgtttatggaacaggaggagtt

SEQ ID NO: 558737 - DNA, 22 bp, Homo sapiens
agaatcataaaatttagagttg

SEQ ID NO: 558738 - DNA, 22 bp, Homo sapiens
gatgggtgtgtattcggggatc

SEQ ID NO: 558739 - DNA, 22 bp, Homo sapiens
gaggccaggaaagttacttaga

SEQ ID NO: 558740 - DNA, 22 bp, Homo sapiens
ggaaagagcactggactgggaa

SEQ ID NO: 558741 - DNA, 22 bp, Homo sapiens
gagggagtgaaatggaatagag

SEQ ID NO: 558742 - DNA, 22 bp, Homo sapiens
tggattcaggatctctccttgg

SEQ ID NO: 558743 - DNA, 22 bp, Homo sapiens
gctagggaggagcatggacctt

SEQ ID NO: 558744 - DNA, 22 bp, Homo sapiens
aaaatgtagatttctgtgctcc

SEQ ID NO: 558745 - DNA, 22 bp, Homo sapiens
gcatgcttctgagatgtctcct

SEQ ID NO: 558746 - DNA, 22 bp, Homo sapiens
gcccaggtgatggttttctggt

SEQ ID NO: 558747 - DNA, 22 bp, Homo sapiens
ggtggccaggtgcatatcttgg

SEQ ID NO: 558748 - DNA, 22 bp, Homo sapiens
tctgagaaaggcaggagatcta

SEQ ID NO: 558749 - DNA, 22 bp, Homo sapiens
tggagatgaaaggcagcttcct

SEQ ID NO: 558750 - DNA, 22 bp, Homo sapiens
caggaggtcctctggagttctg

SEQ ID NO: 558751 - DNA, 22 bp, Homo sapiens
tagtggatcttttcacttgggt

SEQ ID NO: 558752 - DNA, 22 bp, Homo sapiens
cccatcttccctgcctgtccca

SEQ ID NO: 558753 - DNA, 22 bp, Homo sapiens
tggatgggtgaggggggagttg

SEQ ID NO: 558754 - DNA, 22 bp, Homo sapiens
tgcttggcacctagcaagcact

SEQ ID NO: 558755 - DNA, 22 bp, Homo sapiens
ggaggccccaaagagttctatt

SEQ ID NO: 558756 - DNA, 22 bp, Homo sapiens
tgggtctttctttctcttggtg

SEQ ID NO: 558757 - DNA, 22 bp, Homo sapiens
tctcccttcaaatgggtctcgt

SEQ ID NO: 558758 - DNA, 22 bp, Homo sapiens
cctgaagcatcctaggttttgg

SEQ ID NO: 558759 - DNA, 22 bp, Homo sapiens
tcccaactccccttctgcctcc

SEQ ID NO: 558760 - DNA, 22 bp, Homo sapiens
acccacaatatacctgtgtggg

SEQ ID NO: 558761 - DNA, 22 bp, Homo sapiens
gaaagatgaagatgtttaagga

SEQ ID NO: 558762 - DNA, 22 bp, Homo sapiens
tttggagaggtgctttgtttct

SEQ ID NO: 558763 - DNA, 22 bp, Homo sapiens
agagccaggggtggtggctgat

SEQ ID NO: 558764 - DNA, 22 bp, Homo sapiens
tgaccttcatccactaaagaag

SEQ ID NO: 558765 - DNA, 22 bp, Homo sapiens
aatctctcacccatggcctgaa

SEQ ID NO: 558766 - DNA, 22 bp, Homo sapiens
tttctctgtcagtctctctggt

SEQ ID NO: 558767 - DNA, 22 bp, Homo sapiens
agtaggcggagcagggcggtgc

SEQ ID NO: 558768 - DNA, 22 bp, Homo sapiens
tctcatctgtgaaaaagaactg

SEQ ID NO: 558769 - DNA, 22 bp, Homo sapiens
tcgctttcacggcacttggggt

SEQ ID NO: 558770 - DNA, 22 bp, Homo sapiens
tcgctgtcttagaatcacatgt

SEQ ID NO: 558771 - DNA, 22 bp, Homo sapiens
accctaagagagggcagatgtg

SEQ ID NO: 558772 - DNA, 22 bp, Homo sapiens
gcctagtcccagggagacagcc

SEQ ID NO: 558773 - DNA, 22 bp, Homo sapiens
tggggctggggcggtggcactg

SEQ ID NO: 558774 - DNA, 22 bp, Homo sapiens
caagaaagcacttttgcctcat

SEQ ID NO: 558775 - DNA, 22 bp, Homo sapiens
ttttctgggagaggatagtctg

SEQ ID NO: 558776 - DNA, 22 bp, Homo sapiens
tcgattttaaatgctagccatt

SEQ ID NO: 558777 - DNA, 22 bp, Homo sapiens
tccgtgcccatccactcctctt

SEQ ID NO: 558778 - DNA, 22 bp, Homo sapiens
acccccaaccctgctgccagag

SEQ ID NO: 558779 - DNA, 22 bp, Homo sapiens
gaggatgggacgcgtggggact

SEQ ID NO: 558780 - DNA, 22 bp, Homo sapiens
tgtttttcctctggcatgggag

SEQ ID NO: 558781 - DNA, 22 bp, Homo sapiens
taggctggttcctgtaacattg

SEQ ID NO: 558782 - DNA, 22 bp, Homo sapiens
tatctaaagcaggctctattta

SEQ ID NO: 558783 - DNA, 22 bp, Homo sapiens
gagtcctgtatttgtggatgat

SEQ ID NO: 558784 - DNA, 22 bp, Homo sapiens
atgaaattcttggatcactgga

SEQ ID NO: 558785 - DNA, 22 bp, Homo sapiens
ggggtggcgagggaggggttgt

SEQ ID NO: 558786 - DNA, 22 bp, Homo sapiens
cagcactgcttgctgtcactgg

SEQ ID NO: 558787 - DNA, 22 bp, Homo sapiens
ggacatggagtctgcggccgcc

SEQ ID NO: 558788 - DNA, 22 bp, Homo sapiens
ggcacaatgggggcagatgaaa

SEQ ID NO: 558789 - DNA, 22 bp, Homo sapiens
ttattctccctgttttcatcct

SEQ ID NO: 558790 - DNA, 22 bp, Homo sapiens
tcagcaatttgttccattccca

SEQ ID NO: 558791 - DNA, 22 bp, Homo sapiens
tccctacagcctccataaaaac

SEQ ID NO: 558792 - DNA, 22 bp, Homo sapiens
atctttcaattcctccagccct

SEQ ID NO: 558793 - DNA, 22 bp, Homo sapiens
aagcaattgagaggatgtctaa

SEQ ID NO: 558794 - DNA, 22 bp, Homo sapiens
cttgcccacatcccatcacagg

SEQ ID NO: 558795 - DNA, 22 bp, Homo sapiens
tcaggaagctctcctgaatgcc

SEQ ID NO: 558796 - DNA, 22 bp, Homo sapiens
tcagcacagacagccaacgttc

SEQ ID NO: 558797 - DNA, 22 bp, Homo sapiens
cgcccttcctccactcttcctg

SEQ ID NO: 558798 - DNA, 22 bp, Homo sapiens
acatgagctccctgaaagagaa

SEQ ID NO: 558799 - DNA, 22 bp, Homo sapiens
tcctttagaatcatccttgggg

SEQ ID NO: 558800 - DNA, 22 bp, Homo sapiens
tcaacggtctatcttctgaata

SEQ ID NO: 558801 - DNA, 22 bp, Homo sapiens
tggggtcaatatcacgatttat

SEQ ID NO: 558802 - DNA, 22 bp, Homo sapiens
tatttaaaatgtctgaattggg

SEQ ID NO: 558803 - DNA, 22 bp, Homo sapiens
ccaaagtagaaagcaagacaaa

SEQ ID NO: 558804 - DNA, 22 bp, Homo sapiens
tgcctcaagggaaatgaggaga

SEQ ID NO: 558805 - DNA, 22 bp, Homo sapiens
gctcttgcagccccagggactc

SEQ ID NO: 558806 - DNA, 22 bp, Homo sapiens
ctttgatctgtgtgcccatctc

SEQ ID NO: 558807 - DNA, 22 bp, Homo sapiens
tcctgaatccctgcctattttg

SEQ ID NO: 558808 - DNA, 22 bp, Homo sapiens
ggaggctggcatcttgcctctt

SEQ ID NO: 558809 - DNA, 22 bp, Homo sapiens
tgaggattggagaaccaggatt

SEQ ID NO: 558810 - DNA, 22 bp, Homo sapiens
atggcttgctaatttaaagtcc

SEQ ID NO: 558811 - DNA, 22 bp, Homo sapiens
cataatacagggtttatttttt

SEQ ID NO: 558812 - DNA, 22 bp, Homo sapiens
agggggaaaaaggtatgtcttt

SEQ ID NO: 558813 - DNA, 22 bp, Homo sapiens
tcaaagcaggaaaacaaaccac

SEQ ID NO: 558814 - DNA, 22 bp, Homo sapiens
gagctggtcatgaaggctctct

SEQ ID NO: 558815 - DNA, 22 bp, Homo sapiens
tcacagcttggtatcaccagct

SEQ ID NO: 558816 - DNA, 22 bp, Homo sapiens
tctttgagtagagcaggggtac

SEQ ID NO: 558817 - DNA, 22 bp, Homo sapiens
ttggactgcagtgtgcattcag

SEQ ID NO: 558818 - DNA, 22 bp, Homo sapiens
acttttgcactaagctaaatat

SEQ ID NO: 558819 - DNA, 22 bp, Homo sapiens
gaacaaataaaatgattatgtg

SEQ ID NO: 558820 - DNA, 22 bp, Homo sapiens
aggtaaggaagatggagctaag

SEQ ID NO: 558821 - DNA, 22 bp, Homo sapiens
aggtgggaggtggggtgggggg

SEQ ID NO: 558822 - DNA, 22 bp, Homo sapiens
tgctctcagcatcccccatccc

SEQ ID NO: 558823 - DNA, 22 bp, Homo sapiens
atgtcctcatctgcccagtggg

SEQ ID NO: 558824 - DNA, 22 bp, Homo sapiens
gagtactctgtaattgagtgtg

SEQ ID NO: 558825 - DNA, 22 bp, Homo sapiens
aataaaccattttaaaagcttt

SEQ ID NO: 558826 - DNA, 22 bp, Homo sapiens
gtcaacacttgctggtttcctc

SEQ ID NO: 558827 - DNA, 22 bp, Homo sapiens
tcaaggaactccagactgttgg

SEQ ID NO: 558828 - DNA, 22 bp, Homo sapiens
taacttttcagtttgcaagcag

SEQ ID NO: 558829 - DNA, 22 bp, Homo sapiens
tgatgctcagttgtgtgtagat

SEQ ID NO: 558830 - DNA, 22 bp, Homo sapiens
tcatgatgagcatcctgcagca

SEQ ID NO: 558831 - DNA, 22 bp, Homo sapiens
tcagagtacatgctgggttagg

SEQ ID NO: 558832 - DNA, 22 bp, Homo sapiens
tctctttttcgttcccctctcc

SEQ ID NO: 558833 - DNA, 22 bp, Homo sapiens
agaagctgaagggagagagaca

SEQ ID NO: 558834 - DNA, 22 bp, Homo sapiens
tttcaagccagggggcgttttt

SEQ ID NO: 558835 - DNA, 22 bp, Homo sapiens
tactttctcatgcctgggtttc

SEQ ID NO: 558836 - DNA, 22 bp, Homo sapiens
actggctttggaaaagctatat

SEQ ID NO: 558837 - DNA, 22 bp, Homo sapiens
ttcctgcggttggtaggatatt

SEQ ID NO: 558838 - DNA, 22 bp, Homo sapiens
atttgaggctagaatttaacaa

SEQ ID NO: 558839 - DNA, 22 bp, Homo sapiens
tatgtatttatgcacatcgtga

SEQ ID NO: 558840 - DNA, 22 bp, Homo sapiens
ttgtgacagtcttctcattcat

SEQ ID NO: 558841 - DNA, 22 bp, Homo sapiens
tggtggctcatatgtagtctag

SEQ ID NO: 558842 - DNA, 22 bp, Homo sapiens
agccaatgtattatacataatt

SEQ ID NO: 558843 - DNA, 22 bp, Homo sapiens
ttttgtgttcttctagtgtatg

SEQ ID NO: 558844 - DNA, 22 bp, Homo sapiens
tctttcccctcctccatttcct

SEQ ID NO: 558845 - DNA, 22 bp, Homo sapiens
gggcattgggtgattgggcctg

SEQ ID NO: 558846 - DNA, 22 bp, Homo sapiens
ttctcacccacagaagtagaca

SEQ ID NO: 558847 - DNA, 22 bp, Homo sapiens
cagcagatctccatgaaactca

SEQ ID NO: 558848 - DNA, 22 bp, Homo sapiens
tcagaccacgggaggaacccag

SEQ ID NO: 558849 - DNA, 22 bp, Homo sapiens
cagaggggcctggcactgagct

SEQ ID NO: 558850 - DNA, 22 bp, Homo sapiens
tggcggtggagagagggaatgt

SEQ ID NO: 558851 - DNA, 22 bp, Homo sapiens
tgagacacctgagatgaaggca

SEQ ID NO: 558852 - DNA, 22 bp, Homo sapiens
tccattggggcattattttgca

SEQ ID NO: 558853 - DNA, 22 bp, Homo sapiens
tgggggtggcctcaggagccat

SEQ ID NO: 558854 - DNA, 22 bp, Homo sapiens
gattatcaggcctctttctacc

SEQ ID NO: 558855 - DNA, 22 bp, Homo sapiens
gggtcaccacactttgctaact

SEQ ID NO: 558856 - DNA, 22 bp, Homo sapiens
ggaaataaatgcttctgaagtt

SEQ ID NO: 558857 - DNA, 22 bp, Homo sapiens
tgtaccttatgtgatcatgggt

SEQ ID NO: 558858 - DNA, 22 bp, Homo sapiens
taacctggcaggtagagagaaa

SEQ ID NO: 558859 - DNA, 22 bp, Homo sapiens
tagggaggggatacgtctgctt

SEQ ID NO: 558860 - DNA, 22 bp, Homo sapiens
gcagaggcagtggtggggcagc

SEQ ID NO: 558861 - DNA, 22 bp, Homo sapiens
agtgaattgggagccaggctga

SEQ ID NO: 558862 - DNA, 22 bp, Homo sapiens
agggtctgggagacagatgggg

SEQ ID NO: 558863 - DNA, 22 bp, Homo sapiens
cacattgtttggcctctctggc

SEQ ID NO: 558864 - DNA, 22 bp, Homo sapiens
caatgagaacagcaccgcttgg

SEQ ID NO: 558865 - DNA, 22 bp, Homo sapiens
tctcccacgtgccacctcccct

SEQ ID NO: 558866 - DNA, 22 bp, Homo sapiens
tgcagctggtggagtctggggg

SEQ ID NO: 558867 - DNA, 22 bp, Homo sapiens
tcttccagccaaaaccatctca

SEQ ID NO: 558868 - DNA, 22 bp, Homo sapiens
tgtgtgccaagcatagtcctgt

SEQ ID NO: 558869 - DNA, 22 bp, Homo sapiens
tgagatttggcagtttacctaa

SEQ ID NO: 558870 - DNA, 22 bp, Homo sapiens
aaagccagcattatgtttaatt

SEQ ID NO: 558871 - DNA, 22 bp, Homo sapiens
tctggttttctgggagggctct

SEQ ID NO: 558872 - DNA, 22 bp, Homo sapiens
aggagcggggcagcctgagggt

SEQ ID NO: 558873 - DNA, 22 bp, Homo sapiens
ttgttaaacaatttcaaatgca

SEQ ID NO: 558874 - DNA, 22 bp, Homo sapiens
acttcaccaacactggctccct

SEQ ID NO: 558875 - DNA, 22 bp, Homo sapiens
caaattggtgcagcaaagtggt

SEQ ID NO: 558876 - DNA, 22 bp, Homo sapiens
taactggtactctggtagcctg

SEQ ID NO: 558877 - DNA, 22 bp, Homo sapiens
ctatacccacagtgacacagcc

SEQ ID NO: 558878 - DNA, 22 bp, Homo sapiens
ctatgtgccaagcacagtccta

SEQ ID NO: 558879 - DNA, 22 bp, Homo sapiens
taatcaccctgagcagattttg

SEQ ID NO: 558880 - DNA, 22 bp, Homo sapiens
taaacgtcctttcaatcacttt

SEQ ID NO: 558881 - DNA, 22 bp, Homo sapiens
cagaagttcttttttttctctg

SEQ ID NO: 558882 - DNA, 22 bp, Homo sapiens
ctgtaggtctggccgtagccac

SEQ ID NO: 558883 - DNA, 22 bp, Homo sapiens
tccttagtgagttctgtgaaat

SEQ ID NO: 558884 - DNA, 22 bp, Homo sapiens
ttggctggcacagaaatttatt

SEQ ID NO: 558885 - DNA, 22 bp, Homo sapiens
gggcttctctggtgacagggtc

SEQ ID NO: 558886 - DNA, 22 bp, Homo sapiens
tgcagggcccaggtgtccgggt

SEQ ID NO: 558887 - DNA, 22 bp, Homo sapiens
gaaatctttcttccttttctct

SEQ ID NO: 558888 - DNA, 22 bp, Homo sapiens
ctaagtcatcttttagatagtc

SEQ ID NO: 558889 - DNA, 22 bp, Homo sapiens
agactcctctatctagaatatg

SEQ ID NO: 558890 - DNA, 22 bp, Homo sapiens
tagttaatgatatgcatgctga

SEQ ID NO: 558891 - DNA, 22 bp, Homo sapiens
agccacatgtcacagtgccctg

SEQ ID NO: 558892 - DNA, 22 bp, Homo sapiens
tcatgtggcctcatgagcctgg

SEQ ID NO: 558893 - DNA, 22 bp, Homo sapiens
tgccctgccgtgctcacgctgc

SEQ ID NO: 558894 - DNA, 22 bp, Homo sapiens
aagtttgcaaaggcagggaaga

SEQ ID NO: 558895 - DNA, 22 bp, Homo sapiens
tgcattttctcataaaactgcc

SEQ ID NO: 558896 - DNA, 22 bp, Homo sapiens
tgaaacattgcactgtatgaat

SEQ ID NO: 558897 - DNA, 22 bp, Homo sapiens
tgggctggggctgagcctgtcg

SEQ ID NO: 558898 - DNA, 22 bp, Homo sapiens
atgtggtgggggagaggtgtca

SEQ ID NO: 558899 - DNA, 22 bp, Homo sapiens
atggcattgcaagggcaggagg

SEQ ID NO: 558900 - DNA, 22 bp, Homo sapiens
acctagagcaagtcacttgacc

SEQ ID NO: 558901 - DNA, 22 bp, Homo sapiens
ggatggagtccttcagtccaga

SEQ ID NO: 558902 - DNA, 22 bp, Homo sapiens
gggaactggcacagggcagggg

SEQ ID NO: 558903 - DNA, 22 bp, Homo sapiens
tcacactgggtttgagggtcac

SEQ ID NO: 558904 - DNA, 22 bp, Homo sapiens
tccagcttctattatttttctt

SEQ ID NO: 558905 - DNA, 22 bp, Homo sapiens
atctcccgggagccagcccctc

SEQ ID NO: 558906 - DNA, 22 bp, Homo sapiens
cctccggtccccctcccaccca

SEQ ID NO: 558907 - DNA, 22 bp, Homo sapiens
tttacttactgggaaaatctgc

SEQ ID NO: 558908 - DNA, 22 bp, Homo sapiens
taattacctaattacaagctgt

SEQ ID NO: 558909 - DNA, 22 bp, Homo sapiens
tgccttctgggaagagaggcct

SEQ ID NO: 558910 - DNA, 22 bp, Homo sapiens
aacatcctgcatagtgctgcca

SEQ ID NO: 558911 - DNA, 22 bp, Homo sapiens
ttcacgtttgtccatttggatg

SEQ ID NO: 558912 - DNA, 22 bp, Homo sapiens
tggaaccggtattatccctggg

SEQ ID NO: 558913 - DNA, 22 bp, Homo sapiens
cgtactctttgaggcttctggc

SEQ ID NO: 558914 - DNA, 22 bp, Homo sapiens
ggcgcggggatctcgtggctcc

SEQ ID NO: 558915 - DNA, 22 bp, Homo sapiens
tgaggggttctgggaatactat

SEQ ID NO: 558916 - DNA, 22 bp, Homo sapiens
ggctggggaagccagaaaccaa

SEQ ID NO: 558917 - DNA, 22 bp, Homo sapiens
tggtctgttgtctaccctcccg

SEQ ID NO: 558918 - DNA, 22 bp, Homo sapiens
ggtcccaatctgaggagactgg

SEQ ID NO: 558919 - DNA, 22 bp, Homo sapiens
ttctctctcccttccgtctgtt

SEQ ID NO: 558920 - DNA, 22 bp, Homo sapiens
tagttcccaagtgaataaacta

SEQ ID NO: 558921 - DNA, 22 bp, Homo sapiens
tggtatgcaacctcaaatatgg

SEQ ID NO: 558922 - DNA, 22 bp, Homo sapiens
gcatcattgttctctcaggctg

SEQ ID NO: 558923 - DNA, 22 bp, Homo sapiens
agggggcggggagcacatgcgg

SEQ ID NO: 558924 - DNA, 22 bp, Homo sapiens
tttctgcagaactacagagcct

SEQ ID NO: 558925 - DNA, 22 bp, Homo sapiens
tggcacagcctcggcttggccc

SEQ ID NO: 558926 - DNA, 22 bp, Homo sapiens
acagccgtgttccactgccttg

SEQ ID NO: 558927 - DNA, 22 bp, Homo sapiens
gaactattgttcacaattctat

SEQ ID NO: 558928 - DNA, 22 bp, Homo sapiens
tagctggccaccagatgaagtg

SEQ ID NO: 558929 - DNA, 22 bp, Homo sapiens
catggcctgatgagtgatctgg

SEQ ID NO: 558930 - DNA, 22 bp, Homo sapiens
tatctgtgacactttgtttctt

SEQ ID NO: 558931 - DNA, 22 bp, Homo sapiens
taagtattaactctatgaggta

SEQ ID NO: 558932 - DNA, 22 bp, Homo sapiens
ttccttctaaaagttgaagggt

SEQ ID NO: 558933 - DNA, 22 bp, Homo sapiens
aggggtgctggcggtgacatgt

SEQ ID NO: 558934 - DNA, 22 bp, Homo sapiens
taattttttaatgatgtgtgct

SEQ ID NO: 558935 - DNA, 22 bp, Homo sapiens
tttacattatttttcatgcttt

SEQ ID NO: 558936 - DNA, 22 bp, Homo sapiens
cagggccccctccaggctgcct

SEQ ID NO: 558937 - DNA, 22 bp, Homo sapiens
actgaaaagacacatctgaaat

SEQ ID NO: 558938 - DNA, 22 bp, Homo sapiens
gttaacccttcttttcctcttg

SEQ ID NO: 558939 - DNA, 22 bp, Homo sapiens
ggtttgcctaggtgggtcattc

SEQ ID NO: 558940 - DNA, 22 bp, Homo sapiens
agttgcaaaccatctccttagc

SEQ ID NO: 558941 - DNA, 22 bp, Homo sapiens
ctatggttgggagcgttgggtc

SEQ ID NO: 558942 - DNA, 22 bp, Homo sapiens
ttcctcaggctatgaaaaaata

SEQ ID NO: 558943 - DNA, 22 bp, Homo sapiens
cctgtcagtctgaaagctcaga

SEQ ID NO: 558944 - DNA, 22 bp, Homo sapiens
gatctcctgcaattacactggt

SEQ ID NO: 558945 - DNA, 22 bp, Homo sapiens
tatgatcctcagttgtgtgtaa

SEQ ID NO: 558946 - DNA, 22 bp, Homo sapiens
tttattcccaaggttctgtttc

SEQ ID NO: 558947 - DNA, 22 bp, Homo sapiens
tccaggtgggctagaaacatct

SEQ ID NO: 558948 - DNA, 22 bp, Homo sapiens
tctgccagccattctccctgcc

SEQ ID NO: 558949 - DNA, 22 bp, Homo sapiens
ttaggtttcagaagggtgctgg

SEQ ID NO: 558950 - DNA, 22 bp, Homo sapiens
gtgtcagtgtgaaggctggggt

SEQ ID NO: 558951 - DNA, 22 bp, Homo sapiens
tacaagtaatatagcatgtaaa

SEQ ID NO: 558952 - DNA, 22 bp, Homo sapiens
ggatgggaactgccttttacat

SEQ ID NO: 558953 - DNA, 22 bp, Homo sapiens
tttttccactagccccttctct

SEQ ID NO: 558954 - DNA, 22 bp, Homo sapiens
tgggcatcaaccatgactaatt

SEQ ID NO: 558955 - DNA, 22 bp, Homo sapiens
cttctaaacctctaggggtgtg

SEQ ID NO: 558956 - DNA, 22 bp, Homo sapiens
tatatctcatttggatcctaaa

SEQ ID NO: 558957 - DNA, 22 bp, Homo sapiens
agcctgtccctaagtccctccc

SEQ ID NO: 558958 - DNA, 22 bp, Homo sapiens
gggaggaggttcagaggcaata

SEQ ID NO: 558959 - DNA, 22 bp, Homo sapiens
ctgatgcctgcgcttttactta

SEQ ID NO: 558960 - DNA, 22 bp, Homo sapiens
gccgcctccccacctcaccctg

SEQ ID NO: 558961 - DNA, 22 bp, Homo sapiens
tccctccgcctctggccgcgct

SEQ ID NO: 558962 - DNA, 22 bp, Homo sapiens
cctcttccctcctcctgctccg

SEQ ID NO: 558963 - DNA, 22 bp, Homo sapiens
cttgagtctgggaggtcagagg

SEQ ID NO: 558964 - DNA, 22 bp, Homo sapiens
tggctagacctagaattagtca

SEQ ID NO: 558965 - DNA, 22 bp, Homo sapiens
tttccgtagtaactgtgcagga

SEQ ID NO: 558966 - DNA, 22 bp, Homo sapiens
tgggttgacagctcccttgtgt

SEQ ID NO: 558967 - DNA, 22 bp, Homo sapiens
ttaaaaggttgaatgtgtcata

SEQ ID NO: 558968 - DNA, 22 bp, Homo sapiens
cacggcttgaccattttgattg

SEQ ID NO: 558969 - DNA, 22 bp, Homo sapiens
cctcccctgccctggcttggga

SEQ ID NO: 558970 - DNA, 22 bp, Homo sapiens
aagtgagcggcaaggccgtggt

SEQ ID NO: 558971 - DNA, 22 bp, Homo sapiens
tgtttcaagtccccctttctcc

SEQ ID NO: 558972 - DNA, 22 bp, Homo sapiens
tccagctcgagactgactctga

SEQ ID NO: 558973 - DNA, 22 bp, Homo sapiens
ttcctctcctgctctcagtcca

SEQ ID NO: 558974 - DNA, 22 bp, Homo sapiens
tgtcaatcatattgctttatgt

SEQ ID NO: 558975 - DNA, 22 bp, Homo sapiens
tatggtatgtataagaggtatt

SEQ ID NO: 558976 - DNA, 22 bp, Homo sapiens
tgggtggagcggggcgggtcgt

SEQ ID NO: 558977 - DNA, 22 bp, Homo sapiens
tgtgaattgcctgctgtcagcc

SEQ ID NO: 558978 - DNA, 22 bp, Homo sapiens
taagtaacatattttgtgcttt

SEQ ID NO: 558979 - DNA, 22 bp, Homo sapiens
gggtattatggcagctgcagcc

SEQ ID NO: 558980 - DNA, 22 bp, Homo sapiens
ctttcccaagccttgcttccct

SEQ ID NO: 558981 - DNA, 22 bp, Homo sapiens
aaagcgcttcccttcagagtgt

SEQ ID NO: 558982 - DNA, 22 bp, Homo sapiens
tataagaagtgaagaagagtta

SEQ ID NO: 558983 - DNA, 22 bp, Homo sapiens
cagtgagggccatagctctagg

SEQ ID NO: 558984 - DNA, 22 bp, Homo sapiens
catatgaggctgcccttgaatg

SEQ ID NO: 558985 - DNA, 22 bp, Homo sapiens
cccccagaacagctttaagaca

SEQ ID NO: 558986 - DNA, 22 bp, Homo sapiens
ttacaatttaaaagcataggtg

SEQ ID NO: 558987 - DNA, 22 bp, Homo sapiens
aggcttgggccctgcgtgtttc

SEQ ID NO: 558988 - DNA, 22 bp, Homo sapiens
tatgcgattctaagagactgag

SEQ ID NO: 558989 - DNA, 22 bp, Homo sapiens
gggcaggctcgctggcggcgtc

SEQ ID NO: 558990 - DNA, 22 bp, Homo sapiens
ggacagcttctcagaggaagtg

SEQ ID NO: 558991 - DNA, 22 bp, Homo sapiens
cccatcctgccccagctttccc

SEQ ID NO: 558992 - DNA, 22 bp, Homo sapiens
tcccacaagctcagggcctgcg

SEQ ID NO: 558993 - DNA, 22 bp, Homo sapiens
tcctttggggaatggaaacaat

SEQ ID NO: 558994 - DNA, 22 bp, Homo sapiens
tccaaagagagcaactggctta

SEQ ID NO: 558995 - DNA, 22 bp, Homo sapiens
tgcattgcactaatatgctctc

SEQ ID NO: 558996 - DNA, 22 bp, Homo sapiens
ataagggcaaactcgatatgca

SEQ ID NO: 558997 - DNA, 22 bp, Homo sapiens
ttctactcattttacagcttga

SEQ ID NO: 558998 - DNA, 22 bp, Homo sapiens
tgcggaggagaacttcccagag

SEQ ID NO: 558999 - DNA, 22 bp, Homo sapiens
tggtgaggagtgggacgagggc

SEQ ID NO: 559000 - DNA, 22 bp, Homo sapiens
tgccagtgggggtaggagaggg

SEQ ID NO: 559001 - DNA, 22 bp, Homo sapiens
aaatagtacccctgtggtctga

SEQ ID NO: 559002 - DNA, 22 bp, Homo sapiens
tccggcttgcgtgatcactgcc

SEQ ID NO: 559003 - DNA, 22 bp, Homo sapiens
ggctgttcagagtcagatccta

SEQ ID NO: 559004 - DNA, 22 bp, Homo sapiens
gactgattactttagggaaatt

SEQ ID NO: 559005 - DNA, 22 bp, Homo sapiens
tcatgtcattgaatgaaaatct

SEQ ID NO: 559006 - DNA, 22 bp, Homo sapiens
agtctggttatttgtagctggg

SEQ ID NO: 559007 - DNA, 22 bp, Homo sapiens
tcatacatggaagcagatctga

SEQ ID NO: 559008 - DNA, 22 bp, Homo sapiens
tggagatagccccgggtggggg

SEQ ID NO: 559009 - DNA, 22 bp, Homo sapiens
tgcccacaccaggccctggctt

SEQ ID NO: 559010 - DNA, 22 bp, Homo sapiens
taaaagtacagacctttcttga

SEQ ID NO: 559011 - DNA, 22 bp, Homo sapiens
tacccccaaaccttcagctgct

SEQ ID NO: 559012 - DNA, 22 bp, Homo sapiens
tcctcgatcagctcatgctaga

SEQ ID NO: 559013 - DNA, 22 bp, Homo sapiens
cagacctggcatcttgaaagtc

SEQ ID NO: 559014 - DNA, 22 bp, Homo sapiens
ccacaatacagtgggaggcaca

SEQ ID NO: 559015 - DNA, 22 bp, Homo sapiens
acaacaggaaggaccagctggc

SEQ ID NO: 559016 - DNA, 22 bp, Homo sapiens
agggaagcagcagccgcctgtc

SEQ ID NO: 559017 - DNA, 22 bp, Homo sapiens
tctttggctttggagtagttta

SEQ ID NO: 559018 - DNA, 22 bp, Homo sapiens
ttaatgatatacatgcttaagt

SEQ ID NO: 559019 - DNA, 22 bp, Homo sapiens
cgtcgcaacgctccgaggggcg

SEQ ID NO: 559020 - DNA, 22 bp, Homo sapiens
tcatactggatatctttccaca

SEQ ID NO: 559021 - DNA, 22 bp, Homo sapiens
tggtggtctacggctggtctgt

SEQ ID NO: 559022 - DNA, 22 bp, Homo sapiens
tttatgtgtgcaaatagggtaa

SEQ ID NO: 559023 - DNA, 22 bp, Homo sapiens
tgatgaggtccttcttttgtgc

SEQ ID NO: 559024 - DNA, 22 bp, Homo sapiens
cctggcctggggtccacacctg

SEQ ID NO: 559025 - DNA, 22 bp, Homo sapiens
caggcatggaagcaataaaaaa

SEQ ID NO: 559026 - DNA, 22 bp, Homo sapiens
atgaggggtagggaaaaggcac

SEQ ID NO: 559027 - DNA, 22 bp, Homo sapiens
catgtccgtatattttggggac

SEQ ID NO: 559028 - DNA, 22 bp, Homo sapiens
acttgactgtcccggggattaa

SEQ ID NO: 559029 - DNA, 22 bp, Homo sapiens
tccggggttcacgctcgggggt

SEQ ID NO: 559030 - DNA, 22 bp, Homo sapiens
gcactatatttaaacctgtgga

SEQ ID NO: 559031 - DNA, 22 bp, Homo sapiens
tcacagatgactctggaaagga

SEQ ID NO: 559032 - DNA, 22 bp, Homo sapiens
ctcagctcctccacttactagc

SEQ ID NO: 559033 - DNA, 22 bp, Homo sapiens
gacacagcagtgcctgcctcag

SEQ ID NO: 559034 - DNA, 22 bp, Homo sapiens
tagggaagtttggattggggga

SEQ ID NO: 559035 - DNA, 22 bp, Homo sapiens
cagatcatgggaaggagaatgt

SEQ ID NO: 559036 - DNA, 22 bp, Homo sapiens
ccctgctgacgttttggctctg

SEQ ID NO: 559037 - DNA, 22 bp, Homo sapiens
actccctctttgccccttgctg

SEQ ID NO: 559038 - DNA, 22 bp, Homo sapiens
tactgtgctcagtgctatttaa

SEQ ID NO: 559039 - DNA, 22 bp, Homo sapiens
accaggaagcctgagaatgctt

SEQ ID NO: 559040 - DNA, 22 bp, Homo sapiens
cagatgtgccttgcatctgagt

SEQ ID NO: 559041 - DNA, 22 bp, Homo sapiens
tcagacatgtgcattcctgagg

SEQ ID NO: 559042 - DNA, 22 bp, Homo sapiens
taggggaagttcatgcgcagcc

SEQ ID NO: 559043 - DNA, 22 bp, Homo sapiens
tccattatctgctcctaatatt

SEQ ID NO: 559044 - DNA, 22 bp, Homo sapiens
aaggatttagggacaggctttg

SEQ ID NO: 559045 - DNA, 22 bp, Homo sapiens
cgggtggcttctggtcacagcc

SEQ ID NO: 559046 - DNA, 22 bp, Homo sapiens
ttaggctttgtagagctctaag

SEQ ID NO: 559047 - DNA, 22 bp, Homo sapiens
ggttttacctgaagagcgtaaa

SEQ ID NO: 559048 - DNA, 22 bp, Homo sapiens
cagagggaggaatggagtgggg

SEQ ID NO: 559049 - DNA, 22 bp, Homo sapiens
tgtctgtttttcttgccatacc

SEQ ID NO: 559050 - DNA, 22 bp, Homo sapiens
tacaattaggggatgaccttag

SEQ ID NO: 559051 - DNA, 22 bp, Homo sapiens
tgagatttgacatcatgtgagc

SEQ ID NO: 559052 - DNA, 22 bp, Homo sapiens
aagtgatgggggctgatagaca

SEQ ID NO: 559053 - DNA, 22 bp, Homo sapiens
atcctccttaatttactgcctg

SEQ ID NO: 559054 - DNA, 22 bp, Homo sapiens
tgcctgtgggtttaccacttat

SEQ ID NO: 559055 - DNA, 22 bp, Homo sapiens
tctttaattgagcatggataat

SEQ ID NO: 559056 - DNA, 22 bp, Homo sapiens
gtcctcctggctccatcacccc

SEQ ID NO: 559057 - DNA, 22 bp, Homo sapiens
tgttttctcctttcctgccctc

SEQ ID NO: 559058 - DNA, 22 bp, Homo sapiens
taatcatgaggcaagacagtgt

SEQ ID NO: 559059 - DNA, 22 bp, Homo sapiens
ggtggtcttggctacggggtct

SEQ ID NO: 559060 - DNA, 22 bp, Homo sapiens
aaaaatgaccctgagccctttt

SEQ ID NO: 559061 - DNA, 22 bp, Homo sapiens
aatctctcaggagtgtaattat

SEQ ID NO: 559062 - DNA, 22 bp, Homo sapiens
taattagtttgcattactttag

SEQ ID NO: 559063 - DNA, 22 bp, Homo sapiens
tcctggtcccttcatcctcagc

SEQ ID NO: 559064 - DNA, 22 bp, Homo sapiens
tgggtctagagtttgaagagag

SEQ ID NO: 559065 - DNA, 22 bp, Homo sapiens
atgcccctgccctccagcatgt

SEQ ID NO: 559066 - DNA, 22 bp, Homo sapiens
ttaatagaaaaggaggctgtgg

SEQ ID NO: 559067 - DNA, 22 bp, Homo sapiens
tgctatcaagaaatctaatgag

SEQ ID NO: 559068 - DNA, 22 bp, Homo sapiens
aacgcacttccctttagagtgt

SEQ ID NO: 559069 - DNA, 22 bp, Homo sapiens
aggcttagtcaatcagactcaa

SEQ ID NO: 559070 - DNA, 22 bp, Homo sapiens
tacttttatggtgtgtatacca

SEQ ID NO: 559071 - DNA, 22 bp, Homo sapiens
ttggaaagggggtttgggactc

SEQ ID NO: 559072 - DNA, 22 bp, Homo sapiens
tctttctgcattatcagtcatg

SEQ ID NO: 559073 - DNA, 22 bp, Homo sapiens
agactatgacccaggtgatgtg

SEQ ID NO: 559074 - DNA, 22 bp, Homo sapiens
tgaccagctggggttaatggcc

SEQ ID NO: 559075 - DNA, 22 bp, Homo sapiens
agacatcccagcttctatttat

SEQ ID NO: 559076 - DNA, 22 bp, Homo sapiens
ttttcccattagcaaaatgagg

SEQ ID NO: 559077 - DNA, 22 bp, Homo sapiens
ttaggtgctggatgatctctga

SEQ ID NO: 559078 - DNA, 22 bp, Homo sapiens
tcagcattctgtcaggttaact

SEQ ID NO: 559079 - DNA, 22 bp, Homo sapiens
tagtccccagaatgcaaatgct

SEQ ID NO: 559080 - DNA, 22 bp, Homo sapiens
gagtaactgctgatggtgagca

SEQ ID NO: 559081 - DNA, 22 bp, Homo sapiens
ccgggcggtgcggggatgaggc

SEQ ID NO: 559082 - DNA, 22 bp, Homo sapiens
caggtaaaccgccaaatctcag

SEQ ID NO: 559083 - DNA, 22 bp, Homo sapiens
tgtcatgtaatgtgtcatagca

SEQ ID NO: 559084 - DNA, 22 bp, Homo sapiens
tgagcgggtctctgggcctcag

SEQ ID NO: 559085 - DNA, 22 bp, Homo sapiens
cacacgggatgggcagggagac

SEQ ID NO: 559086 - DNA, 22 bp, Homo sapiens
gctgggtgaggagggtggggat

SEQ ID NO: 559087 - DNA, 22 bp, Homo sapiens
gcggctctccaggacaccccgc

SEQ ID NO: 559088 - DNA, 22 bp, Homo sapiens
gtctttcttcagagcttggact

SEQ ID NO: 559089 - DNA, 22 bp, Homo sapiens
aaagtgcatccttttagagtgt

SEQ ID NO: 559090 - DNA, 22 bp, Homo sapiens
agagttttatcatacgtggata

SEQ ID NO: 559091 - DNA, 22 bp, Homo sapiens
tctccccttttctcaagcccag

SEQ ID NO: 559092 - DNA, 22 bp, Homo sapiens
tctgtgattcatgcagatgcca

SEQ ID NO: 559093 - DNA, 22 bp, Homo sapiens
tggagttgggggaacattgtgt

SEQ ID NO: 559094 - DNA, 22 bp, Homo sapiens
cattctgagcaattaagaagtt

SEQ ID NO: 559095 - DNA, 22 bp, Homo sapiens
tggttgttgcccacatctgttc

SEQ ID NO: 559096 - DNA, 22 bp, Homo sapiens
tttccctcagagcttgaaggct

SEQ ID NO: 559097 - DNA, 22 bp, Homo sapiens
actggtttctgagatggaactt

SEQ ID NO: 559098 - DNA, 22 bp, Homo sapiens
tcatcaacatgcagcctgtgaa

SEQ ID NO: 559099 - DNA, 22 bp, Homo sapiens
ttctttcacagatggggagaaa

SEQ ID NO: 559100 - DNA, 22 bp, Homo sapiens
agtgagggtagaggcaggagtg

SEQ ID NO: 559101 - DNA, 22 bp, Homo sapiens
ttgatgcgccatttggcctaag

SEQ ID NO: 559102 - DNA, 22 bp, Homo sapiens
tggtgattattttgctcaatat

SEQ ID NO: 559103 - DNA, 22 bp, Homo sapiens
tttaccaggattgccacctgcc

SEQ ID NO: 559104 - DNA, 22 bp, Homo sapiens
ttctgtcttgctgctggggtgg

SEQ ID NO: 559105 - DNA, 22 bp, Homo sapiens
tccatagaaatccctgagagtc

SEQ ID NO: 559106 - DNA, 22 bp, Homo sapiens
tatttggaccaattgtgagagc

SEQ ID NO: 559107 - DNA, 22 bp, Homo sapiens
tatggcctgaagtatatgtggc

SEQ ID NO: 559108 - DNA, 22 bp, Homo sapiens
gcgctgtctttgagcccccgcc

SEQ ID NO: 559109 - DNA, 22 bp, Homo sapiens
tgttttattattcatttgaggg

SEQ ID NO: 559110 - DNA, 22 bp, Homo sapiens
tcacagtgtgtccttgacagca

SEQ ID NO: 559111 - DNA, 22 bp, Homo sapiens
tggcggtagtccagctggggcg

SEQ ID NO: 559112 - DNA, 22 bp, Homo sapiens
tcctcggattcccggatgtggg

SEQ ID NO: 559113 - DNA, 22 bp, Homo sapiens
aaagaggtggatggtttccctt

SEQ ID NO: 559114 - DNA, 22 bp, Homo sapiens
actgggccaagagcgggggcac

SEQ ID NO: 559115 - DNA, 22 bp, Homo sapiens
tttcatagaagcaccacctatg

SEQ ID NO: 559116 - DNA, 22 bp, Homo sapiens
accctcccctcaccccaattcc

SEQ ID NO: 559117 - DNA, 22 bp, Homo sapiens
gagatgttgaaggactggagct

SEQ ID NO: 559118 - DNA, 22 bp, Homo sapiens
ctcttcccaggatgctgagtga

SEQ ID NO: 559119 - DNA, 22 bp, Homo sapiens
gaaagaggaaagaaaatatctt

SEQ ID NO: 559120 - DNA, 22 bp, Homo sapiens
cagcagggagggggggaggagg

SEQ ID NO: 559121 - DNA, 22 bp, Homo sapiens
ctatttcacagatgaggagact

SEQ ID NO: 559122 - DNA, 22 bp, Homo sapiens
tcgtcaatatgcagcctgtgaa

SEQ ID NO: 559123 - DNA, 22 bp, Homo sapiens
ggtgttgctagtttgaaaagac

SEQ ID NO: 559124 - DNA, 22 bp, Homo sapiens
tcttggagaagggattgtgctc

SEQ ID NO: 559125 - DNA, 22 bp, Homo sapiens
tggtggctttggcgctggtggc

SEQ ID NO: 559126 - DNA, 22 bp, Homo sapiens
tggtttttggtttccagagcag

SEQ ID NO: 559127 - DNA, 22 bp, Homo sapiens
tttctgcctgtcctccctcctg

SEQ ID NO: 559128 - DNA, 22 bp, Homo sapiens
tggcctctggaatataagaaat

SEQ ID NO: 559129 - DNA, 22 bp, Homo sapiens
gcaggaaaccacttcagtccct

SEQ ID NO: 559130 - DNA, 22 bp, Homo sapiens
ttgcttctaaggctcctgaaac

SEQ ID NO: 559131 - DNA, 22 bp, Homo sapiens
aatttcaatgcttcctcttatg

SEQ ID NO: 559132 - DNA, 22 bp, Homo sapiens
aaaaatgactctggtccttttc

SEQ ID NO: 559133 - DNA, 22 bp, Homo sapiens
tatggggggtcctgggaggaga

SEQ ID NO: 559134 - DNA, 22 bp, Homo sapiens
tggcagtgggtggcactgtgtc

SEQ ID NO: 559135 - DNA, 22 bp, Homo sapiens
tagctactgtatttggaggagg

SEQ ID NO: 559136 - DNA, 22 bp, Homo sapiens
tctgtgaggcagggctgtcttc

SEQ ID NO: 559137 - DNA, 22 bp, Homo sapiens
aaagagcagtggctccatgcac

SEQ ID NO: 559138 - DNA, 22 bp, Homo sapiens
tcccacccacctgcccgtggta

SEQ ID NO: 559139 - DNA, 22 bp, Homo sapiens
cccatttgatgtggtttgggcc

SEQ ID NO: 559140 - DNA, 22 bp, Homo sapiens
ttgacaaagtgtgcctgtcatt

SEQ ID NO: 559141 - DNA, 22 bp, Homo sapiens
gggagataattacactttcact

SEQ ID NO: 559142 - DNA, 22 bp, Homo sapiens
tgactgatcattctagaggctg

SEQ ID NO: 559143 - DNA, 22 bp, Homo sapiens
catctgtggaagtgggagagaa

SEQ ID NO: 559144 - DNA, 22 bp, Homo sapiens
tttttcaatattctgaaataga

SEQ ID NO: 559145 - DNA, 22 bp, Homo sapiens
ccatatcatggcactgagggaa

SEQ ID NO: 559146 - DNA, 22 bp, Homo sapiens
tggacatttccctgaaggcctg

SEQ ID NO: 559147 - DNA, 22 bp, Homo sapiens
tcagagcgtcctcttccacccc

SEQ ID NO: 559148 - DNA, 22 bp, Homo sapiens
caggggacgtggaggagcagag

SEQ ID NO: 559149 - DNA, 22 bp, Homo sapiens
gcgttgcccggatgtgggaggc

SEQ ID NO: 559150 - DNA, 22 bp, Homo sapiens
gtatgtgagtgctgtggcatgg

SEQ ID NO: 559151 - DNA, 22 bp, Homo sapiens
tgtgacagttaaggcaaatgtg

SEQ ID NO: 559152 - DNA, 22 bp, Homo sapiens
aagaagagatggtggttgtgca

SEQ ID NO: 559153 - DNA, 22 bp, Homo sapiens
tacttggaaaggcatcagttgc

SEQ ID NO: 559154 - DNA, 22 bp, Homo sapiens
agccatggctgagagtttacag

SEQ ID NO: 559155 - DNA, 22 bp, Homo sapiens
ttggtcattcattctgatgttt

SEQ ID NO: 559156 - DNA, 22 bp, Homo sapiens
tgagtggtgcttaagttcaggc

SEQ ID NO: 559157 - DNA, 22 bp, Homo sapiens
tctgttttgtgtctctctggtg

SEQ ID NO: 559158 - DNA, 22 bp, Homo sapiens
aacaaatgacagtacgatttcc

SEQ ID NO: 559159 - DNA, 22 bp, Homo sapiens
ggaggggggaggaggcaagaag

SEQ ID NO: 559160 - DNA, 22 bp, Homo sapiens
cacacatctctaattcagttct

SEQ ID NO: 559161 - DNA, 22 bp, Homo sapiens
tgttttccttgcaagacaaggg

SEQ ID NO: 559162 - DNA, 22 bp, Homo sapiens
tctggtaacctttatccctcct

SEQ ID NO: 559163 - DNA, 22 bp, Homo sapiens
taagggtgctgctctctgtgac

SEQ ID NO: 559164 - DNA, 22 bp, Homo sapiens
ccactgaaaatttgacattgtt

SEQ ID NO: 559165 - DNA, 22 bp, Homo sapiens
tgaatgaaagagggcctgctca

SEQ ID NO: 559166 - DNA, 22 bp, Homo sapiens
ttttgcagtccttagctgttgc

SEQ ID NO: 559167 - DNA, 22 bp, Homo sapiens
ttcatttaatatctctcctccc

SEQ ID NO: 559168 - DNA, 22 bp, Homo sapiens
agctggagattaactgggcatc

SEQ ID NO: 559169 - DNA, 22 bp, Homo sapiens
tggaagagactgtggttcccca

SEQ ID NO: 559170 - DNA, 22 bp, Homo sapiens
tggcactagggtcagcagttct

SEQ ID NO: 559171 - DNA, 22 bp, Homo sapiens
ggtctttgccctggatattaga

SEQ ID NO: 559172 - DNA, 22 bp, Homo sapiens
tgccttcttcacatcattcatg

SEQ ID NO: 559173 - DNA, 22 bp, Homo sapiens
tattacatgaaaccttgagcaa

SEQ ID NO: 559174 - DNA, 22 bp, Homo sapiens
tgtcagccccacttctgcctgc

SEQ ID NO: 559175 - DNA, 22 bp, Homo sapiens
tagatacggtccgagaactcct

SEQ ID NO: 559176 - DNA, 22 bp, Homo sapiens
atcccaggaagagtagacaggc

SEQ ID NO: 559177 - DNA, 22 bp, Homo sapiens
caacttctcattaatccttcga

SEQ ID NO: 559178 - DNA, 22 bp, Homo sapiens
ttaagaaaaacagtcatcctgc

SEQ ID NO: 559179 - DNA, 22 bp, Homo sapiens
gtgcctgctatgtgccaggcat

SEQ ID NO: 559180 - DNA, 22 bp, Homo sapiens
tcataggttttttcccccattt

SEQ ID NO: 559181 - DNA, 22 bp, Homo sapiens
ttgaaatgttttgcttgctctt

SEQ ID NO: 559182 - DNA, 22 bp, Homo sapiens
tactcttgcttcttgttttagg

SEQ ID NO: 559183 - DNA, 22 bp, Homo sapiens
tgaagtctagatacaaatgcca

SEQ ID NO: 559184 - DNA, 22 bp, Homo sapiens
tgggagagtgtctggaggcctg

SEQ ID NO: 559185 - DNA, 22 bp, Homo sapiens
aggcagattcttacggcagttg

SEQ ID NO: 559186 - DNA, 22 bp, Homo sapiens
tgcacctgtgtgctaaggtcag

SEQ ID NO: 559187 - DNA, 22 bp, Homo sapiens
tactgtctttggggttgttatt

SEQ ID NO: 559188 - DNA, 22 bp, Homo sapiens
ggggagggtggcggaggccggg

SEQ ID NO: 559189 - DNA, 22 bp, Homo sapiens
agggaggaggaggctcagggac

SEQ ID NO: 559190 - DNA, 22 bp, Homo sapiens
ccagctgggggctggccttggc

SEQ ID NO: 559191 - DNA, 22 bp, Homo sapiens
ggcactgagttacctgccccaa

SEQ ID NO: 559192 - DNA, 22 bp, Homo sapiens
caggccttggaggtagcacgcg

SEQ ID NO: 559193 - DNA, 22 bp, Homo sapiens
tgccttcctgccttccattcta

SEQ ID NO: 559194 - DNA, 22 bp, Homo sapiens
cctgaagcccattctgaggctc

SEQ ID NO: 559195 - DNA, 22 bp, Homo sapiens
ggggagtaagtctggtccatgt

SEQ ID NO: 559196 - DNA, 22 bp, Homo sapiens
aatgtattcagttttgactttg

SEQ ID NO: 559197 - DNA, 22 bp, Homo sapiens
atattcagttcccctttgtggc

SEQ ID NO: 559198 - DNA, 22 bp, Homo sapiens
ggccgcgcagccgcagagtgcg

SEQ ID NO: 559199 - DNA, 22 bp, Homo sapiens
gaggcctgaggcagcttccctc

SEQ ID NO: 559200 - DNA, 22 bp, Homo sapiens
catcccaccccagcactgcctt

SEQ ID NO: 559201 - DNA, 22 bp, Homo sapiens
ggtccatgatccactaagacct

SEQ ID NO: 559202 - DNA, 22 bp, Homo sapiens
cagggctgtttttgtttctcct

SEQ ID NO: 559203 - DNA, 22 bp, Homo sapiens
cctttatattgcattctttctt

SEQ ID NO: 559204 - DNA, 22 bp, Homo sapiens
aaaaagggtagcacaggaagct

SEQ ID NO: 559205 - DNA, 22 bp, Homo sapiens
ttgttactcaaatagagttctc

SEQ ID NO: 559206 - DNA, 22 bp, Homo sapiens
ggtgatggagagagacagagct

SEQ ID NO: 559207 - DNA, 22 bp, Homo sapiens
tgagaaaggagagcttaatgtg

SEQ ID NO: 559208 - DNA, 22 bp, Homo sapiens
ggggtggcactgtgccttgttc

SEQ ID NO: 559209 - DNA, 22 bp, Homo sapiens
ccctgtcctcagccacctctgg

SEQ ID NO: 559210 - DNA, 22 bp, Homo sapiens
ccagggttagatgctagtcttg

SEQ ID NO: 559211 - DNA, 22 bp, Homo sapiens
tggaaacaaaatattggagcta

SEQ ID NO: 559212 - DNA, 22 bp, Homo sapiens
agtaacagttggcttacatctt

SEQ ID NO: 559213 - DNA, 22 bp, Homo sapiens
ggcgtgagcgagcagggaagag

SEQ ID NO: 559214 - DNA, 22 bp, Homo sapiens
tctgcacctgtaggatgaagtc

SEQ ID NO: 559215 - DNA, 22 bp, Homo sapiens
taaatcacagaaggttgcatta

SEQ ID NO: 559216 - DNA, 22 bp, Homo sapiens
tctgttcatttgcctcggctct

SEQ ID NO: 559217 - DNA, 22 bp, Homo sapiens
gatgcgaggtaaggaatgtgct

SEQ ID NO: 559218 - DNA, 22 bp, Homo sapiens
tcagtttgctgcacagatattt

SEQ ID NO: 559219 - DNA, 22 bp, Homo sapiens
ttcacagaattggagcatctta

SEQ ID NO: 559220 - DNA, 22 bp, Homo sapiens
tccaacatcataacctcagctc

SEQ ID NO: 559221 - DNA, 22 bp, Homo sapiens
caagaggaagggaaggcggcca

SEQ ID NO: 559222 - DNA, 22 bp, Homo sapiens
tggggatttcatagggcaaaca

SEQ ID NO: 559223 - DNA, 22 bp, Homo sapiens
tctgacaagcacatgtgcaaat

SEQ ID NO: 559224 - DNA, 22 bp, Homo sapiens
aactgcctgaggcctaaaagac

SEQ ID NO: 559225 - DNA, 22 bp, Homo sapiens
tgctcaagaagctgaagtctgt

SEQ ID NO: 559226 - DNA, 22 bp, Homo sapiens
tggtgagcctggaggaagactt

SEQ ID NO: 559227 - DNA, 22 bp, Homo sapiens
gtgggttggctgagggctcatg

SEQ ID NO: 559228 - DNA, 22 bp, Homo sapiens
tccttgagggcataattagtca

SEQ ID NO: 559229 - DNA, 22 bp, Homo sapiens
tcaccaccaggtggcagtattg

SEQ ID NO: 559230 - DNA, 22 bp, Homo sapiens
atagggttccagaggaaaggaa

SEQ ID NO: 559231 - DNA, 22 bp, Homo sapiens
ccatccatcagtatttgtggtt

SEQ ID NO: 559232 - DNA, 22 bp, Homo sapiens
agctggtctcaaatgttccttc

SEQ ID NO: 559233 - DNA, 22 bp, Homo sapiens
actgccccatcttatccctcct

SEQ ID NO: 559234 - DNA, 22 bp, Homo sapiens
tgggttattttggtctagtggg

SEQ ID NO: 559235 - DNA, 22 bp, Homo sapiens
tgcctgggacctgcccaagaca

SEQ ID NO: 559236 - DNA, 22 bp, Homo sapiens
ttattagatgcttacctgcgcc

SEQ ID NO: 559237 - DNA, 22 bp, Homo sapiens
tgatgtatggaccaaatgatgt

SEQ ID NO: 559238 - DNA, 22 bp, Homo sapiens
caaaaccttgtccttcctgccc

SEQ ID NO: 559239 - DNA, 22 bp, Homo sapiens
ttccctctttcctctgtatgtt

SEQ ID NO: 559240 - DNA, 22 bp, Homo sapiens
cctccctacaaggaagagataa

SEQ ID NO: 559241 - DNA, 22 bp, Homo sapiens
acagagcacattgtgttcatgg

SEQ ID NO: 559242 - DNA, 22 bp, Homo sapiens
tggggaatagttttgttctttt

SEQ ID NO: 559243 - DNA, 22 bp, Homo sapiens
aaggaggacccctcctgagcaa

SEQ ID NO: 559244 - DNA, 22 bp, Homo sapiens
tattcttgtctcaaggagatgt

SEQ ID NO: 559245 - DNA, 22 bp, Homo sapiens
ttcctgtcaccttgctctccta

SEQ ID NO: 559246 - DNA, 22 bp, Homo sapiens
tagctccacatgccctggcctg

SEQ ID NO: 559247 - DNA, 22 bp, Homo sapiens
aggagtaagtgtgaatggataa

SEQ ID NO: 559248 - DNA, 22 bp, Homo sapiens
cagtggagggtggctgggagtg

SEQ ID NO: 559249 - DNA, 22 bp, Homo sapiens
aaggcccgatcgcaggcactcc

SEQ ID NO: 559250 - DNA, 22 bp, Homo sapiens
aatgctgttgattcagcttatt

SEQ ID NO: 559251 - DNA, 22 bp, Homo sapiens
ccagctgtactgcctgctcagg

SEQ ID NO: 559252 - DNA, 22 bp, Homo sapiens
tggtcccattgaatcccaacag

SEQ ID NO: 559253 - DNA, 22 bp, Homo sapiens
atgccgctgggagctcagaggg

SEQ ID NO: 559254 - DNA, 22 bp, Homo sapiens
tctcatcatgggcatgtgtcgt

SEQ ID NO: 559255 - DNA, 22 bp, Homo sapiens
ggagggcattcttgggtagatg

SEQ ID NO: 559256 - DNA, 22 bp, Homo sapiens
agtgactcaagaaaatggaagc

SEQ ID NO: 559257 - DNA, 22 bp, Homo sapiens
gcggggaggatgaggggcactg

SEQ ID NO: 559258 - DNA, 22 bp, Homo sapiens
cattccctgacagcctctttca

SEQ ID NO: 559259 - DNA, 22 bp, Homo sapiens
ttctgcagaggcggcacacagt

SEQ ID NO: 559260 - DNA, 22 bp, Homo sapiens
ttccaagagcttatttctgaat

SEQ ID NO: 559261 - DNA, 22 bp, Homo sapiens
aactggtaacagaagagcactt

SEQ ID NO: 559262 - DNA, 22 bp, Homo sapiens
cagagctgggcttggctggtcc

SEQ ID NO: 559263 - DNA, 22 bp, Homo sapiens
gctcctgctgtcataaacactt

SEQ ID NO: 559264 - DNA, 22 bp, Homo sapiens
ttaatggctggctgggaggcag

SEQ ID NO: 559265 - DNA, 22 bp, Homo sapiens
tatatagggatataattttagc

SEQ ID NO: 559266 - DNA, 22 bp, Homo sapiens
ggtgcaggtatgttacttttac

SEQ ID NO: 559267 - DNA, 22 bp, Homo sapiens
cgctacacagctcatcaggttc

SEQ ID NO: 559268 - DNA, 22 bp, Homo sapiens
tctggcatcctgggggcagtgg

SEQ ID NO: 559269 - DNA, 22 bp, Homo sapiens
cggtctcaccaaacgccccaaa

SEQ ID NO: 559270 - DNA, 22 bp, Homo sapiens
gtgattcactcaagtaccagtg

SEQ ID NO: 559271 - DNA, 22 bp, Homo sapiens
accagcttgttggccatgttac

SEQ ID NO: 559272 - DNA, 22 bp, Homo sapiens
ttagtggtcattgttaaggtca

SEQ ID NO: 559273 - DNA, 22 bp, Homo sapiens
tcaagaggtgtgccttagtcac

SEQ ID NO: 559274 - DNA, 22 bp, Homo sapiens
taaaattgatcccaaggtcctt

SEQ ID NO: 559275 - DNA, 22 bp, Homo sapiens
ttctcactcacagaagtagatt

SEQ ID NO: 559276 - DNA, 22 bp, Homo sapiens
tttatattttctttataagaaa

SEQ ID NO: 559277 - DNA, 22 bp, Homo sapiens
aagtttttatgtgtctctctgg

SEQ ID NO: 559278 - DNA, 22 bp, Homo sapiens
atttcccaaagaaacctttctt

SEQ ID NO: 559279 - DNA, 22 bp, Homo sapiens
tcaactttgtttcctgttggtt

SEQ ID NO: 559280 - DNA, 22 bp, Homo sapiens
tctcctcctcccactgccagac

SEQ ID NO: 559281 - DNA, 22 bp, Homo sapiens
ttctccaactgtcctccccaca

SEQ ID NO: 559282 - DNA, 22 bp, Homo sapiens
ggtttttctgtctacctgtaaa

SEQ ID NO: 559283 - DNA, 22 bp, Homo sapiens
gcaagtaaatcttcaactatac

SEQ ID NO: 559284 - DNA, 22 bp, Homo sapiens
actgcatgctgggacctgtagt

SEQ ID NO: 559285 - DNA, 22 bp, Homo sapiens
ttttttctccaaacagaaatct

SEQ ID NO: 559286 - DNA, 22 bp, Homo sapiens
tcagaggtcccgttcctccctc

SEQ ID NO: 559287 - DNA, 22 bp, Homo sapiens
tggggggggccagtgaggcagg

SEQ ID NO: 559288 - DNA, 22 bp, Homo sapiens
tgtaatggaaagtggggagggg

SEQ ID NO: 559289 - DNA, 22 bp, Homo sapiens
tatatatacaaacacatactta

SEQ ID NO: 559290 - DNA, 22 bp, Homo sapiens
tgcattgttttgtttctttcat

SEQ ID NO: 559291 - DNA, 22 bp, Homo sapiens
tagtaagccttttgggaactgt

SEQ ID NO: 559292 - DNA, 22 bp, Homo sapiens
ccattaacctcagttggtcact

SEQ ID NO: 559293 - DNA, 22 bp, Homo sapiens
caagtcactgttcttcaatgac

SEQ ID NO: 559294 - DNA, 22 bp, Homo sapiens
tgtgtccagacgccagctgcct

SEQ ID NO: 559295 - DNA, 22 bp, Homo sapiens
agctgttcaaatgagtcactct

SEQ ID NO: 559296 - DNA, 22 bp, Homo sapiens
agaggtgaaagtgcttatgcag

SEQ ID NO: 559297 - DNA, 22 bp, Homo sapiens
gcagagtggaacttgtctcttt

SEQ ID NO: 559298 - DNA, 22 bp, Homo sapiens
taaccaataaattaagcaaaac

SEQ ID NO: 559299 - DNA, 22 bp, Homo sapiens
gtgcttagccctggaatatgct

SEQ ID NO: 559300 - DNA, 22 bp, Homo sapiens
caaaggcttttagaggatgttg

SEQ ID NO: 559301 - DNA, 22 bp, Homo sapiens
tcagctcactgcactgctcctg

SEQ ID NO: 559302 - DNA, 22 bp, Homo sapiens
tccctggtgttaaatcaacact

SEQ ID NO: 559303 - DNA, 22 bp, Homo sapiens
taaaatggggatgatgataaca

SEQ ID NO: 559304 - DNA, 22 bp, Homo sapiens
tgctttcagtttcttttgaaaa

SEQ ID NO: 559305 - DNA, 22 bp, Homo sapiens
agtggtggaaagggtagcctcc

SEQ ID NO: 559306 - DNA, 22 bp, Homo sapiens
ctgtagttaaaggtctgttagc

SEQ ID NO: 559307 - DNA, 22 bp, Homo sapiens
cctcagtttcctcctttgaagc

SEQ ID NO: 559308 - DNA, 22 bp, Homo sapiens
cagcttattgggacactgatca

SEQ ID NO: 559309 - DNA, 22 bp, Homo sapiens
tgcaaggtttctctctgcctaa

SEQ ID NO: 559310 - DNA, 22 bp, Homo sapiens
tacaatgttgggaagggtcaaa

SEQ ID NO: 559311 - DNA, 22 bp, Homo sapiens
tttctcttgtgtgttccacttt

SEQ ID NO: 559312 - DNA, 22 bp, Homo sapiens
taaatatgatgctagcttttag

SEQ ID NO: 559313 - DNA, 22 bp, Homo sapiens
tgaaacaaattgccataaaatg

SEQ ID NO: 559314 - DNA, 22 bp, Homo sapiens
tctgatactggcaatcttgcca

SEQ ID NO: 559315 - DNA, 22 bp, Homo sapiens
ccattcaagcacgaagcttcct

SEQ ID NO: 559316 - DNA, 22 bp, Homo sapiens
gagcttgggggttgtcgttaag

SEQ ID NO: 559317 - DNA, 22 bp, Homo sapiens
cttttgaaatgatttagactca

SEQ ID NO: 559318 - DNA, 22 bp, Homo sapiens
cataccatagatacctgttctt

SEQ ID NO: 559319 - DNA, 22 bp, Homo sapiens
tgacatcatttaaaagcctttt

SEQ ID NO: 559320 - DNA, 22 bp, Homo sapiens
tgtatggggtctttatggatgc

SEQ ID NO: 559321 - DNA, 22 bp, Homo sapiens
tggcaggcagtgccctgggcaa

SEQ ID NO: 559322 - DNA, 22 bp, Homo sapiens
ttatcttccattgccaagtcct

SEQ ID NO: 559323 - DNA, 22 bp, Homo sapiens
cggaatagcagttcccaatctg

SEQ ID NO: 559324 - DNA, 22 bp, Homo sapiens
tactccttccttcctcaccatg

SEQ ID NO: 559325 - DNA, 22 bp, Homo sapiens
aggaggcttctggatctttcca

SEQ ID NO: 559326 - DNA, 22 bp, Homo sapiens
caagaaatccaggaaagggctg

SEQ ID NO: 559327 - DNA, 22 bp, Homo sapiens
tagacagaggaggcagcataat

SEQ ID NO: 559328 - DNA, 22 bp, Homo sapiens
tcccttccccctttccctcaac

SEQ ID NO: 559329 - DNA, 22 bp, Homo sapiens
taagtaaaatctcagagtgtgc

SEQ ID NO: 559330 - DNA, 22 bp, Homo sapiens
atttgaatggttttgactagcc

SEQ ID NO: 559331 - DNA, 22 bp, Homo sapiens
tttcagcccttgacattccagg

SEQ ID NO: 559332 - DNA, 22 bp, Homo sapiens
ttcccttctaagagctgacgga

SEQ ID NO: 559333 - DNA, 22 bp, Homo sapiens
gaaggagggaggggaggggaga

SEQ ID NO: 559334 - DNA, 22 bp, Homo sapiens
tcctgggatgacttttgaaatg

SEQ ID NO: 559335 - DNA, 22 bp, Homo sapiens
ccatatggcctcaagttagcat

SEQ ID NO: 559336 - DNA, 22 bp, Homo sapiens
tctgctcctctaattgatacgg

SEQ ID NO: 559337 - DNA, 22 bp, Homo sapiens
ttctagcagctggtgcagtggg

SEQ ID NO: 559338 - DNA, 22 bp, Homo sapiens
tggatggtcgaccagttggaaa

SEQ ID NO: 559339 - DNA, 22 bp, Homo sapiens
cccttcatttgctcttggctag

SEQ ID NO: 559340 - DNA, 22 bp, Homo sapiens
gctcttgatttgagagaagggc

SEQ ID NO: 559341 - DNA, 22 bp, Homo sapiens
gcatttggaaaaggtgaattga

SEQ ID NO: 559342 - DNA, 22 bp, Homo sapiens
caatgcctggcacatattaggc

SEQ ID NO: 559343 - DNA, 22 bp, Homo sapiens
tggaggagagtgagggaatgat

SEQ ID NO: 559344 - DNA, 22 bp, Homo sapiens
ccagctggtggggaagctgcag

SEQ ID NO: 559345 - DNA, 22 bp, Homo sapiens
cacagagaagcacagggcccag

SEQ ID NO: 559346 - DNA, 22 bp, Homo sapiens
tgtgaagttgcaaagcaaggat

SEQ ID NO: 559347 - DNA, 22 bp, Homo sapiens
gaactgggacagaaatcggaag

SEQ ID NO: 559348 - DNA, 22 bp, Homo sapiens
tgctttacatattttaactctt

SEQ ID NO: 559349 - DNA, 22 bp, Homo sapiens
cagagcgtgctgagcaagcgga

SEQ ID NO: 559350 - DNA, 22 bp, Homo sapiens
atgcccaggaggagggaggagc

SEQ ID NO: 559351 - DNA, 22 bp, Homo sapiens
tctgactggtgcttacttcagt

SEQ ID NO: 559352 - DNA, 22 bp, Homo sapiens
tgaaaccaagtatgggtcgcct

SEQ ID NO: 559353 - DNA, 22 bp, Homo sapiens
aacaggccagcaagtcttggag

SEQ ID NO: 559354 - DNA, 22 bp, Homo sapiens
acgctcactccgtgtccgcgac

SEQ ID NO: 559355 - DNA, 22 bp, Homo sapiens
taataatagctgtcatttgttg

SEQ ID NO: 559356 - DNA, 22 bp, Homo sapiens
tgccagctgtctggtactcact

SEQ ID NO: 559357 - DNA, 22 bp, Homo sapiens
ccctggttctgcctgtgagctg

SEQ ID NO: 559358 - DNA, 22 bp, Homo sapiens
tagtgtacgatggctccctggc

SEQ ID NO: 559359 - DNA, 22 bp, Homo sapiens
acagaagccacttagagcgtaa

SEQ ID NO: 559360 - DNA, 22 bp, Homo sapiens
tgtgcttgagtgctggagcatg

SEQ ID NO: 559361 - DNA, 22 bp, Homo sapiens
tctgctgctcaaactggagttg

SEQ ID NO: 559362 - DNA, 22 bp, Homo sapiens
ttgatcaatgcaagatgggaag

SEQ ID NO: 559363 - DNA, 22 bp, Homo sapiens
tatcttgaaggaggaggaataa

SEQ ID NO: 559364 - DNA, 22 bp, Homo sapiens
ggggagatgctggcctgaagca

SEQ ID NO: 559365 - DNA, 22 bp, Homo sapiens
gagcttattcataaaagtgcag

SEQ ID NO: 559366 - DNA, 22 bp, Homo sapiens
tgacatcctttaagatctcctt

SEQ ID NO: 559367 - DNA, 22 bp, Homo sapiens
agaagtgccgggaacaagaggt

SEQ ID NO: 559368 - DNA, 22 bp, Homo sapiens
cagatggaggagcatccaggtt

SEQ ID NO: 559369 - DNA, 22 bp, Homo sapiens
ttgagatgtgcctagttctgta

SEQ ID NO: 559370 - DNA, 22 bp, Homo sapiens
cttgactgtgttccttgcattg

SEQ ID NO: 559371 - DNA, 22 bp, Homo sapiens
tgtattcagtcttccagatcgc

SEQ ID NO: 559372 - DNA, 22 bp, Homo sapiens
taagaggaaatatcacttagta

SEQ ID NO: 559373 - DNA, 22 bp, Homo sapiens
tccaaactccaaaatgaatatg

SEQ ID NO: 559374 - DNA, 22 bp, Homo sapiens
acccctgggctctgggctccct

SEQ ID NO: 559375 - DNA, 22 bp, Homo sapiens
tgtgctcatgaccactgggtgg

SEQ ID NO: 559376 - DNA, 22 bp, Homo sapiens
tgagccttagccagcagaggac

SEQ ID NO: 559377 - DNA, 22 bp, Homo sapiens
ataaaatctaaaacattgcatt

SEQ ID NO: 559378 - DNA, 22 bp, Homo sapiens
aggtgatgtaaggctggggagg

SEQ ID NO: 559379 - DNA, 22 bp, Homo sapiens
ggtcctgagtgaggaagagagt

SEQ ID NO: 559380 - DNA, 22 bp, Homo sapiens
aattactgctagcaagacgcaa

SEQ ID NO: 559381 - DNA, 22 bp, Homo sapiens
tctaatacctatacccagtcat

SEQ ID NO: 559382 - DNA, 22 bp, Homo sapiens
tgagcagatttgttctaggggt

SEQ ID NO: 559383 - DNA, 22 bp, Homo sapiens
gggattccgaggtgtttccatt

SEQ ID NO: 559384 - DNA, 22 bp, Homo sapiens
aacctagtactggttctggcat

SEQ ID NO: 559385 - DNA, 22 bp, Homo sapiens
cactaggagtctcaaaaagact

SEQ ID NO: 559386 - DNA, 22 bp, Homo sapiens
aaacgcctggatctttgacagg

SEQ ID NO: 559387 - DNA, 22 bp, Homo sapiens
gaaagtatggagtgctggaggg

SEQ ID NO: 559388 - DNA, 22 bp, Homo sapiens
agtgctgctccttttccagatg

SEQ ID NO: 559389 - DNA, 22 bp, Homo sapiens
tgagttcccggatctgttccat

SEQ ID NO: 559390 - DNA, 22 bp, Homo sapiens
tggggattttgtggtttgaaga

SEQ ID NO: 559391 - DNA, 22 bp, Homo sapiens
aaatgaactaaagctgatttag

SEQ ID NO: 559392 - DNA, 22 bp, Homo sapiens
ggagagggcacaggcttggctc

SEQ ID NO: 559393 - DNA, 22 bp, Homo sapiens
caggttttattgaacacatgta

SEQ ID NO: 559394 - DNA, 22 bp, Homo sapiens
tcaggcatgcagacaggtttgg

SEQ ID NO: 559395 - DNA, 22 bp, Homo sapiens
tcaatacacattgaccatatta

SEQ ID NO: 559396 - DNA, 22 bp, Homo sapiens
tcatccgatgtacaataatttc

SEQ ID NO: 559397 - DNA, 22 bp, Homo sapiens
ttgtaggtaaatacccaaggga

SEQ ID NO: 559398 - DNA, 22 bp, Homo sapiens
caatcacagcttaatctaatta

SEQ ID NO: 559399 - DNA, 22 bp, Homo sapiens
ttattaaacaggttcagaaaca

SEQ ID NO: 559400 - DNA, 22 bp, Homo sapiens
tcatttctcattactgcccttg

SEQ ID NO: 559401 - DNA, 22 bp, Homo sapiens
tgcagctatgtcatggtgactg

SEQ ID NO: 559402 - DNA, 22 bp, Homo sapiens
ttgattaggttgatactaattg

SEQ ID NO: 559403 - DNA, 22 bp, Homo sapiens
aggtgtatacgattgtgcttct

SEQ ID NO: 559404 - DNA, 22 bp, Homo sapiens
tctggggaagccattttgtaga

SEQ ID NO: 559405 - DNA, 22 bp, Homo sapiens
tttttgtttagtgttttggggc

SEQ ID NO: 559406 - DNA, 22 bp, Homo sapiens
caacagcatgggctcctccttc

SEQ ID NO: 559407 - DNA, 22 bp, Homo sapiens
tgctacattctgcctagaacta

SEQ ID NO: 559408 - DNA, 22 bp, Homo sapiens
gctagagaggtgggggaagaga

SEQ ID NO: 559409 - DNA, 22 bp, Homo sapiens
ccttggccatcagggcagatgc

SEQ ID NO: 559410 - DNA, 22 bp, Homo sapiens
ttgttttcttagtctgtgtgtt

SEQ ID NO: 559411 - DNA, 22 bp, Homo sapiens
ttctgcgaagcctgccctcatt

SEQ ID NO: 559412 - DNA, 22 bp, Homo sapiens
acataagagatatgttaaacta

SEQ ID NO: 559413 - DNA, 22 bp, Homo sapiens
gttgcagctgcagctatgaaga

SEQ ID NO: 559414 - DNA, 22 bp, Homo sapiens
tggatggaggttgagagggctg

SEQ ID NO: 559415 - DNA, 22 bp, Homo sapiens
tccagtatctgtgatgggttaa

SEQ ID NO: 559416 - DNA, 22 bp, Homo sapiens
aaaggaggcctgattggggggc

SEQ ID NO: 559417 - DNA, 22 bp, Homo sapiens
atgtagtgggctctgagtaagc

SEQ ID NO: 559418 - DNA, 22 bp, Homo sapiens
tcaggatatctgggagctactt

SEQ ID NO: 559419 - DNA, 22 bp, Homo sapiens
agcactggcctgggagtcaggg

SEQ ID NO: 559420 - DNA, 22 bp, Homo sapiens
agtgttaattaaacctctattt

SEQ ID NO: 559421 - DNA, 22 bp, Homo sapiens
tctcctggctctttctattttc

SEQ ID NO: 559422 - DNA, 22 bp, Homo sapiens
tggtgaatcaaaactgagagaa

SEQ ID NO: 559423 - DNA, 22 bp, Homo sapiens
gtattcattgagtgcttcttat

SEQ ID NO: 559424 - DNA, 22 bp, Homo sapiens
ttccatgacctgcctctgaacc

SEQ ID NO: 559425 - DNA, 22 bp, Homo sapiens
tgggattttctgcctgagggtg

SEQ ID NO: 559426 - DNA, 22 bp, Homo sapiens
ggattccctggaccatccttta

SEQ ID NO: 559427 - DNA, 22 bp, Homo sapiens
aagagtcagggagccagatgct

SEQ ID NO: 559428 - DNA, 22 bp, Homo sapiens
ctgggcgttcctgggcgccggg

SEQ ID NO: 559429 - DNA, 22 bp, Homo sapiens
tcgcccctatagaactcaaccc

SEQ ID NO: 559430 - DNA, 22 bp, Homo sapiens
cacttgtaatattttgtaatta

SEQ ID NO: 559431 - DNA, 22 bp, Homo sapiens
tttgagttctagcgcatttaat

SEQ ID NO: 559432 - DNA, 22 bp, Homo sapiens
ttcagcctgtgctcccagaatg

SEQ ID NO: 559433 - DNA, 22 bp, Homo sapiens
cctcctaccctcccatcaccgc

SEQ ID NO: 559434 - DNA, 22 bp, Homo sapiens
taatgtgaaggactaagagaag

SEQ ID NO: 559435 - DNA, 22 bp, Homo sapiens
aaaggggaaaaggcgagaagag

SEQ ID NO: 559436 - DNA, 22 bp, Homo sapiens
ttttatgttatcccccagagaa

SEQ ID NO: 559437 - DNA, 22 bp, Homo sapiens
aggcagaagggatggtgagggg

SEQ ID NO: 559438 - DNA, 22 bp, Homo sapiens
atctgctgtctctgctcttcac

SEQ ID NO: 559439 - DNA, 22 bp, Homo sapiens
tagctgggtgtagggggctttt

SEQ ID NO: 559440 - DNA, 22 bp, Homo sapiens
ggtccctcccctgcagctactg

SEQ ID NO: 559441 - DNA, 22 bp, Homo sapiens
ttctcctaatttttctcacagc

SEQ ID NO: 559442 - DNA, 22 bp, Homo sapiens
gagcatatgcagcagcggctgc

SEQ ID NO: 559443 - DNA, 22 bp, Homo sapiens
tgctgggccttgggtgcactca

SEQ ID NO: 559444 - DNA, 22 bp, Homo sapiens
gggaagggcagggtctatgcac

SEQ ID NO: 559445 - DNA, 22 bp, Homo sapiens
tcccagtaggcattagcacctg

SEQ ID NO: 559446 - DNA, 22 bp, Homo sapiens
tatgtatatgtttaaaaaataa

SEQ ID NO: 559447 - DNA, 22 bp, Homo sapiens
taactgaggcccagagaagcga

SEQ ID NO: 559448 - DNA, 22 bp, Homo sapiens
aaggctgtgtcctcattttata

SEQ ID NO: 559449 - DNA, 22 bp, Homo sapiens
tttgtcaatgttgctttgagaa

SEQ ID NO: 559450 - DNA, 22 bp, Homo sapiens
tagcagcttgtatttatatttt

SEQ ID NO: 559451 - DNA, 22 bp, Homo sapiens
tgatttgagcagtgctggctgc

SEQ ID NO: 559452 - DNA, 22 bp, Homo sapiens
acatggttaacttctggctccc

SEQ ID NO: 559453 - DNA, 22 bp, Homo sapiens
atttcgagtcagtgggctgtga

SEQ ID NO: 559454 - DNA, 22 bp, Homo sapiens
actcatctttggcaatgtggcc

SEQ ID NO: 559455 - DNA, 22 bp, Homo sapiens
cctgtgcttttaaattgtaatc

SEQ ID NO: 559456 - DNA, 22 bp, Homo sapiens
tttcttttagcaaagatgagga

SEQ ID NO: 559457 - DNA, 22 bp, Homo sapiens
tcctcctccctttgctttattt

SEQ ID NO: 559458 - DNA, 22 bp, Homo sapiens
agttttgtttttcaaaataata

SEQ ID NO: 559459 - DNA, 22 bp, Homo sapiens
tgaagaaccatgactagtgttt

SEQ ID NO: 559460 - DNA, 22 bp, Homo sapiens
gatgattcctttgttcattgtg

SEQ ID NO: 559461 - DNA, 22 bp, Homo sapiens
aacatacacatgaagacaactt

SEQ ID NO: 559462 - DNA, 22 bp, Homo sapiens
tgcatgtgtgccatggaagcac

SEQ ID NO: 559463 - DNA, 22 bp, Homo sapiens
tcagcatggcagggattagtag

SEQ ID NO: 559464 - DNA, 22 bp, Homo sapiens
agaccacaggggtactatttta

SEQ ID NO: 559465 - DNA, 22 bp, Homo sapiens
tatattccagagggtagggccg

SEQ ID NO: 559466 - DNA, 22 bp, Homo sapiens
ccctttctaaacaaaaggactc

SEQ ID NO: 559467 - DNA, 22 bp, Homo sapiens
aggtcattacctgcggccgcgg

SEQ ID NO: 559468 - DNA, 22 bp, Homo sapiens
taggaggagagaagggcgacat

SEQ ID NO: 559469 - DNA, 22 bp, Homo sapiens
gtataactagtaagttatacta

SEQ ID NO: 559470 - DNA, 22 bp, Homo sapiens
tgtgaggcctgggtggaggcct

SEQ ID NO: 559471 - DNA, 22 bp, Homo sapiens
ggggtcagggagacttggagct

SEQ ID NO: 559472 - DNA, 22 bp, Homo sapiens
tgccctctctgggccttgattc

SEQ ID NO: 559473 - DNA, 22 bp, Homo sapiens
taaagatgcaatcaggcctcct

SEQ ID NO: 559474 - DNA, 22 bp, Homo sapiens
aggcctcagttggtcataacct

SEQ ID NO: 559475 - DNA, 22 bp, Homo sapiens
gaaggagacggtgatgatgggg

SEQ ID NO: 559476 - DNA, 22 bp, Homo sapiens
gccctcaccgctactcctttca

SEQ ID NO: 559477 - DNA, 22 bp, Homo sapiens
cagatcctctctctgcaacggt

SEQ ID NO: 559478 - DNA, 22 bp, Homo sapiens
ggggtggggggatgtgtttgtt

SEQ ID NO: 559479 - DNA, 22 bp, Homo sapiens
gaacagggctcatcttctgaga

SEQ ID NO: 559480 - DNA, 22 bp, Homo sapiens
tggtgacagggatgtggtggtg

SEQ ID NO: 559481 - DNA, 22 bp, Homo sapiens
tggtggtatcattgaaataaca

SEQ ID NO: 559482 - DNA, 22 bp, Homo sapiens
aagctttggttaagtgaaaaag

SEQ ID NO: 559483 - DNA, 22 bp, Homo sapiens
tgcactggattgtcagtattta

SEQ ID NO: 559484 - DNA, 22 bp, Homo sapiens
tttatgccctcctttataatta

SEQ ID NO: 559485 - DNA, 22 bp, Homo sapiens
gcagggccacatgactccagca

SEQ ID NO: 559486 - DNA, 22 bp, Homo sapiens
ttattccacagctcagaatttt

SEQ ID NO: 559487 - DNA, 22 bp, Homo sapiens
gctctccccacgttggctccca

SEQ ID NO: 559488 - DNA, 22 bp, Homo sapiens
tcagggttcctactgacaaggg

SEQ ID NO: 559489 - DNA, 22 bp, Homo sapiens
tggagagagccaggggctggag

SEQ ID NO: 559490 - DNA, 22 bp, Homo sapiens
taatattaaattcctctctctc

SEQ ID NO: 559491 - DNA, 22 bp, Homo sapiens
ggggcactatgggctctctgga

SEQ ID NO: 559492 - DNA, 22 bp, Homo sapiens
tggggagggcctggggagcgcc

SEQ ID NO: 559493 - DNA, 22 bp, Homo sapiens
tttgttcatggccccatcttgg

SEQ ID NO: 559494 - DNA, 22 bp, Homo sapiens
actccagtaattttaaattgct

SEQ ID NO: 559495 - DNA, 22 bp, Homo sapiens
gcttttcaatatgtttggcatg

SEQ ID NO: 559496 - DNA, 22 bp, Homo sapiens
tgtgtgggcaaggcagccagct

SEQ ID NO: 559497 - DNA, 22 bp, Homo sapiens
tagtgcttttggacagacattg

SEQ ID NO: 559498 - DNA, 22 bp, Homo sapiens
ttggggtatggggagatctttt

SEQ ID NO: 559499 - DNA, 22 bp, Homo sapiens
gaagggaggaaggcctctctac

SEQ ID NO: 559500 - DNA, 22 bp, Homo sapiens
tcgtgtcactgtgaggatattg

SEQ ID NO: 559501 - DNA, 22 bp, Homo sapiens
agactaacaggatgctgttttc

SEQ ID NO: 559502 - DNA, 22 bp, Homo sapiens
atttggctggagccttagcctg

SEQ ID NO: 559503 - DNA, 22 bp, Homo sapiens
ggtctgcagaggtgggtgaggg

SEQ ID NO: 559504 - DNA, 22 bp, Homo sapiens
agccaggctggggtggcacagt

SEQ ID NO: 559505 - DNA, 22 bp, Homo sapiens
tcattttcatgaggaactgggg

SEQ ID NO: 559506 - DNA, 22 bp, Homo sapiens
tggcacagtgcccccagcaagg

SEQ ID NO: 559507 - DNA, 22 bp, Homo sapiens
tggaggttctcacatctccacc

SEQ ID NO: 559508 - DNA, 22 bp, Homo sapiens
aatgctggctgggttagtagcc

SEQ ID NO: 559509 - DNA, 22 bp, Homo sapiens
ttaggagaagaacaagccttct

SEQ ID NO: 559510 - DNA, 22 bp, Homo sapiens
accactctatgcctcagtttcc

SEQ ID NO: 559511 - DNA, 22 bp, Homo sapiens
ctgcggctggcatggacccagg

SEQ ID NO: 559512 - DNA, 22 bp, Homo sapiens
ttaaaaggaagaggcatcccag

SEQ ID NO: 559513 - DNA, 22 bp, Homo sapiens
tgtgggttggggaaggaggaga

SEQ ID NO: 559514 - DNA, 22 bp, Homo sapiens
gtgggtcactcacatgggggtt

SEQ ID NO: 559515 - DNA, 22 bp, Homo sapiens
ttagggtaggatggttgtaggt

SEQ ID NO: 559516 - DNA, 22 bp, Homo sapiens
tggggtgcggctctgagggggt

SEQ ID NO: 559517 - DNA, 22 bp, Homo sapiens
gggaaccaagcgtccactgtgc

SEQ ID NO: 559518 - DNA, 22 bp, Homo sapiens
atagtgaccgttagagacttat

SEQ ID NO: 559519 - DNA, 22 bp, Homo sapiens
tgtggatggctgggaagaggtt

SEQ ID NO: 559520 - DNA, 22 bp, Homo sapiens
gtgcataattgagggcagaatt

SEQ ID NO: 559521 - DNA, 22 bp, Homo sapiens
caagagcctcggcgtcctcgcc

SEQ ID NO: 559522 - DNA, 22 bp, Homo sapiens
ggggccaagtttcttggatgag

SEQ ID NO: 559523 - DNA, 22 bp, Homo sapiens
tgagggctgaggccaggggaga

SEQ ID NO: 559524 - DNA, 22 bp, Homo sapiens
ctaggtccctggtaggtatgga

SEQ ID NO: 559525 - DNA, 22 bp, Homo sapiens
ccttcctcgggcacccctcctg

SEQ ID NO: 559526 - DNA, 22 bp, Homo sapiens
ggtactattattgaccctgagg

SEQ ID NO: 559527 - DNA, 22 bp, Homo sapiens
aggcaagcatggcgtttggagc

SEQ ID NO: 559528 - DNA, 22 bp, Homo sapiens
tttctgttctgttcatctgttc

SEQ ID NO: 559529 - DNA, 22 bp, Homo sapiens
tgaaggcatcatgttttggatc

SEQ ID NO: 559530 - DNA, 22 bp, Homo sapiens
cgtatctccctccccactgcgc

SEQ ID NO: 559531 - DNA, 22 bp, Homo sapiens
aagagagacatctgagtcagac

SEQ ID NO: 559532 - DNA, 22 bp, Homo sapiens
gagtcctttccctgtctccctc

SEQ ID NO: 559533 - DNA, 22 bp, Homo sapiens
ttatctcagattactcttggct

SEQ ID NO: 559534 - DNA, 22 bp, Homo sapiens
taaatctgcacccactgaaaat

SEQ ID NO: 559535 - DNA, 22 bp, Homo sapiens
tcccctactgagtcctgagacc

SEQ ID NO: 559536 - DNA, 22 bp, Homo sapiens
tacagagggccagggacttagg

SEQ ID NO: 559537 - DNA, 22 bp, Homo sapiens
tgtagagatagatgtggcctgg

SEQ ID NO: 559538 - DNA, 22 bp, Homo sapiens
tgtggatttgattgcttttttt

SEQ ID NO: 559539 - DNA, 22 bp, Homo sapiens
ttagaagaagcaagtttccttt

SEQ ID NO: 559540 - DNA, 22 bp, Homo sapiens
tacttctccaggagccacttac

SEQ ID NO: 559541 - DNA, 22 bp, Homo sapiens
tccaagtgtggtgtttggcaca

SEQ ID NO: 559542 - DNA, 22 bp, Homo sapiens
aattggtgtcccatttgttggg

SEQ ID NO: 559543 - DNA, 22 bp, Homo sapiens
tgtgccatgttggtgtgctgca

SEQ ID NO: 559544 - DNA, 22 bp, Homo sapiens
attagtagaggcatttagttct

SEQ ID NO: 559545 - DNA, 22 bp, Homo sapiens
ttcttcatagtgccacttcctt

SEQ ID NO: 559546 - DNA, 22 bp, Homo sapiens
acttggattaggtaattggaca

SEQ ID NO: 559547 - DNA, 22 bp, Homo sapiens
tgttgagggctaggcaatctac

SEQ ID NO: 559548 - DNA, 22 bp, Homo sapiens
gagcctcttcaaaacagagccc

SEQ ID NO: 559549 - DNA, 22 bp, Homo sapiens
aactagctgcctgccttgaggt

SEQ ID NO: 559550 - DNA, 22 bp, Homo sapiens
ttttccagccatgacatttcag

SEQ ID NO: 559551 - DNA, 22 bp, Homo sapiens
tacttttgccccaacctaatac

SEQ ID NO: 559552 - DNA, 22 bp, Homo sapiens
tcaccacacttcctggtgcctg

SEQ ID NO: 559553 - DNA, 22 bp, Homo sapiens
ttaccagtgtgggaacggcttt

SEQ ID NO: 559554 - DNA, 22 bp, Homo sapiens
gggcaggggtggggtggggaga

SEQ ID NO: 559555 - DNA, 22 bp, Homo sapiens
ggcaccagaagtgctgacgagg

SEQ ID NO: 559556 - DNA, 22 bp, Homo sapiens
gcaggagccgaggggctggtct

SEQ ID NO: 559557 - DNA, 22 bp, Homo sapiens
tcctccacatggctgaggtgtg

SEQ ID NO: 559558 - DNA, 22 bp, Homo sapiens
ggttgacagcagcatgaactac

SEQ ID NO: 559559 - DNA, 22 bp, Homo sapiens
cagcggggtgtagtggatagag

SEQ ID NO: 559560 - DNA, 22 bp, Homo sapiens
ttagtcccagtttaccaggccc

SEQ ID NO: 559561 - DNA, 22 bp, Homo sapiens
ctcaaaccggctgtgcctgtgg

SEQ ID NO: 559562 - DNA, 22 bp, Homo sapiens
acttggaacgccaaccttgctc

SEQ ID NO: 559563 - DNA, 22 bp, Homo sapiens
aggaatgttttccagacctaga

SEQ ID NO: 559564 - DNA, 22 bp, Homo sapiens
agactgtcctaggaggggctgc

SEQ ID NO: 559565 - DNA, 22 bp, Homo sapiens
ggttttaggcaggtgtgatatt

SEQ ID NO: 559566 - DNA, 22 bp, Homo sapiens
atggtttccatttaggagaagc

SEQ ID NO: 559567 - DNA, 22 bp, Homo sapiens
ggttttgttgtgtgtatccaag

SEQ ID NO: 559568 - DNA, 22 bp, Homo sapiens
ggtcccctggggtcacacagtg

SEQ ID NO: 559569 - DNA, 22 bp, Homo sapiens
ggcagtgtagtgtaagggcatg

SEQ ID NO: 559570 - DNA, 22 bp, Homo sapiens
taccccattgtgacggagcact

SEQ ID NO: 559571 - DNA, 22 bp, Homo sapiens
gaggaggggaaatgaaaggata

SEQ ID NO: 559572 - DNA, 22 bp, Homo sapiens
tgaaagcagctgcagaaccctt

SEQ ID NO: 559573 - DNA, 22 bp, Homo sapiens
tgagctgtgattgcatgcaggt

SEQ ID NO: 559574 - DNA, 22 bp, Homo sapiens
accagggggaggagggtgttgg

SEQ ID NO: 559575 - DNA, 22 bp, Homo sapiens
tccatccccaaccctgccttcc

SEQ ID NO: 559576 - DNA, 22 bp, Homo sapiens
gcctaagaggtaaatattgact

SEQ ID NO: 559577 - DNA, 22 bp, Homo sapiens
aaagttggtgaatgcacctgct

SEQ ID NO: 559578 - DNA, 22 bp, Homo sapiens
agagggtcctgagcaggaatgc

SEQ ID NO: 559579 - DNA, 22 bp, Homo sapiens
tcagcaggaaagcatgcaagtc

SEQ ID NO: 559580 - DNA, 22 bp, Homo sapiens
tctgagctgggatgcagtggtc

SEQ ID NO: 559581 - DNA, 22 bp, Homo sapiens
cctagggggccgggcagaagag

SEQ ID NO: 559582 - DNA, 22 bp, Homo sapiens
tgcttaggtccctgttgttcat

SEQ ID NO: 559583 - DNA, 22 bp, Homo sapiens
cagggagtggaaaggagctgaa

SEQ ID NO: 559584 - DNA, 22 bp, Homo sapiens
aggcaggggctggtgctgggcg

SEQ ID NO: 559585 - DNA, 22 bp, Homo sapiens
ttgctgagaaccacatatttga

SEQ ID NO: 559586 - DNA, 22 bp, Homo sapiens
ttgaatggatgtgtcagagggg

SEQ ID NO: 559587 - DNA, 22 bp, Homo sapiens
ttgcagactgatcagagatggt

SEQ ID NO: 559588 - DNA, 22 bp, Homo sapiens
ctcctcaggatgctgccatgtg

SEQ ID NO: 559589 - DNA, 22 bp, Homo sapiens
ttcaactctgattttacatacg

SEQ ID NO: 559590 - DNA, 22 bp, Homo sapiens
cctttgaccgttttcctgccca

SEQ ID NO: 559591 - DNA, 22 bp, Homo sapiens
ggttcctcccagctggtcatta

SEQ ID NO: 559592 - DNA, 22 bp, Homo sapiens
catgtgtgtgtgtggaatacaa

SEQ ID NO: 559593 - DNA, 22 bp, Homo sapiens
cctgctgcatgctctgtgtgat

SEQ ID NO: 559594 - DNA, 22 bp, Homo sapiens
gagtgggaggacgtcggggggt

SEQ ID NO: 559595 - DNA, 22 bp, Homo sapiens
tgggcggcccctgcctgctccg

SEQ ID NO: 559596 - DNA, 22 bp, Homo sapiens
gacgtgcgcggacgcgggcaag

SEQ ID NO: 559597 - DNA, 22 bp, Homo sapiens
tgggaggtttccttttggatct

SEQ ID NO: 559598 - DNA, 22 bp, Homo sapiens
aaagtacatactgttatattcc

SEQ ID NO: 559599 - DNA, 22 bp, Homo sapiens
tgtctgtcctctcataggatca

SEQ ID NO: 559600 - DNA, 22 bp, Homo sapiens
gatcctgccctaagatgttata

SEQ ID NO: 559601 - DNA, 22 bp, Homo sapiens
tcttgttctctggaaatcccct

SEQ ID NO: 559602 - DNA, 22 bp, Homo sapiens
tgcactccacctcgtcctgaga

SEQ ID NO: 559603 - DNA, 22 bp, Homo sapiens
tactgggaatttggtggggtgg

SEQ ID NO: 559604 - DNA, 22 bp, Homo sapiens
cagtaatgcatacaagttagtg

SEQ ID NO: 559605 - DNA, 22 bp, Homo sapiens
tggctgtgattgggcccagggc

SEQ ID NO: 559606 - DNA, 22 bp, Homo sapiens
tccaagcagaatcacgtgagag

SEQ ID NO: 559607 - DNA, 22 bp, Homo sapiens
cagacttgacctacaattagcc

SEQ ID NO: 559608 - DNA, 22 bp, Homo sapiens
tttctgtgtcagtctctctggt

SEQ ID NO: 559609 - DNA, 22 bp, Homo sapiens
tccgggaaacattgctgaagga

SEQ ID NO: 559610 - DNA, 22 bp, Homo sapiens
gagctaagaaacctctgaatgg

SEQ ID NO: 559611 - DNA, 22 bp, Homo sapiens
agctcagggaggcatttgtcat

SEQ ID NO: 559612 - DNA, 22 bp, Homo sapiens
aggaagtgactgtatctacaag

SEQ ID NO: 559613 - DNA, 22 bp, Homo sapiens
tcttataaagaaatgataaatc

SEQ ID NO: 559614 - DNA, 22 bp, Homo sapiens
gaagagcctacagtttagtctt

SEQ ID NO: 559615 - DNA, 22 bp, Homo sapiens
aaggtggagatgagaggcttct

SEQ ID NO: 559616 - DNA, 22 bp, Homo sapiens
aggatctcgtttcaaaagggtt

SEQ ID NO: 559617 - DNA, 22 bp, Homo sapiens
tctagattctaggatagttgct

SEQ ID NO: 559618 - DNA, 22 bp, Homo sapiens
tcagtctcaccagtaacagcct

SEQ ID NO: 559619 - DNA, 22 bp, Homo sapiens
gagacacaaaatgtggaaagaa

SEQ ID NO: 559620 - DNA, 22 bp, Homo sapiens
tggaaaacagacaaaaaacagc

SEQ ID NO: 559621 - DNA, 22 bp, Homo sapiens
tcctgggcagtactcacctcca

SEQ ID NO: 559622 - DNA, 22 bp, Homo sapiens
ttgatgacatttcataactcat

SEQ ID NO: 559623 - DNA, 22 bp, Homo sapiens
tgttgtgtcagtttatcaaacc

SEQ ID NO: 559624 - DNA, 22 bp, Homo sapiens
agaaaagaggaaagaaagcact

SEQ ID NO: 559625 - DNA, 22 bp, Homo sapiens
tgaccagcccaggcatcggccc

SEQ ID NO: 559626 - DNA, 22 bp, Homo sapiens
tgtttttgggggtgggtggccc

SEQ ID NO: 559627 - DNA, 22 bp, Homo sapiens
tggcacacagtaagccctaagt

SEQ ID NO: 559628 - DNA, 22 bp, Homo sapiens
tgcaggctgagcttaggctggg

SEQ ID NO: 559629 - DNA, 22 bp, Homo sapiens
tgttctcctaggtcccactgaa

SEQ ID NO: 559630 - DNA, 22 bp, Homo sapiens
cacagaatagcacaatttacaa

SEQ ID NO: 559631 - DNA, 22 bp, Homo sapiens
caccatccctccctccagtagc

SEQ ID NO: 559632 - DNA, 22 bp, Homo sapiens
ttttgagttactgtgtccaacc

SEQ ID NO: 559633 - DNA, 22 bp, Homo sapiens
cacataagcatgttttatttgc

SEQ ID NO: 559634 - DNA, 22 bp, Homo sapiens
tctttctaacacttttctgata

SEQ ID NO: 559635 - DNA, 22 bp, Homo sapiens
tgggcatgtgggcagggtgctg

SEQ ID NO: 559636 - DNA, 22 bp, Homo sapiens
ggtacaaatggttgggattatt

SEQ ID NO: 559637 - DNA, 22 bp, Homo sapiens
tgaccggatgtttattcaaata

SEQ ID NO: 559638 - DNA, 22 bp, Homo sapiens
tgatcaataataagattgatac

SEQ ID NO: 559639 - DNA, 22 bp, Homo sapiens
cagcagattcatggtgtccggc

SEQ ID NO: 559640 - DNA, 22 bp, Homo sapiens
tgccggaagacaagttgcactg

SEQ ID NO: 559641 - DNA, 22 bp, Homo sapiens
tttgggagactttgacgaaaga

SEQ ID NO: 559642 - DNA, 22 bp, Homo sapiens
cccctttcatatgcccagatct

SEQ ID NO: 559643 - DNA, 22 bp, Homo sapiens
ccagaattttgtgaacagttgt

SEQ ID NO: 559644 - DNA, 22 bp, Homo sapiens
tatttaggaggaaactgaggtt

SEQ ID NO: 559645 - DNA, 22 bp, Homo sapiens
tggtgctgcgggaacccagggt

SEQ ID NO: 559646 - DNA, 22 bp, Homo sapiens
tggtggacagaggagaggggaa

SEQ ID NO: 559647 - DNA, 22 bp, Homo sapiens
tctggcacagttcactggacct

SEQ ID NO: 559648 - DNA, 22 bp, Homo sapiens
tgttttcatttcttcatccttg

SEQ ID NO: 559649 - DNA, 22 bp, Homo sapiens
gcggagcgggtcggggagggaa

SEQ ID NO: 559650 - DNA, 22 bp, Homo sapiens
tggtcttttttatctgctcatt

SEQ ID NO: 559651 - DNA, 22 bp, Homo sapiens
tatgcattgaccctgccatcaa

SEQ ID NO: 559652 - DNA, 22 bp, Homo sapiens
acctctgccaggagatatttcc

SEQ ID NO: 559653 - DNA, 22 bp, Homo sapiens
tttctcactctccattcaccca

SEQ ID NO: 559654 - DNA, 22 bp, Homo sapiens
tggggtggggaggtatggtgag

SEQ ID NO: 559655 - DNA, 22 bp, Homo sapiens
tttcagtttctttgtttccagc

SEQ ID NO: 559656 - DNA, 22 bp, Homo sapiens
actattccctttctgagtagag

SEQ ID NO: 559657 - DNA, 22 bp, Homo sapiens
tagtgccaaggggaatattggg

SEQ ID NO: 559658 - DNA, 22 bp, Homo sapiens
tcctccccgccgtcgcgcccta

SEQ ID NO: 559659 - DNA, 22 bp, Homo sapiens
gctctgagaataaagtgaggga

SEQ ID NO: 559660 - DNA, 22 bp, Homo sapiens
agatttcatttgctatgctttc

SEQ ID NO: 559661 - DNA, 22 bp, Homo sapiens
ttgttttgttcattcatgcatc

SEQ ID NO: 559662 - DNA, 22 bp, Homo sapiens
ttcagtacttatgggcatgttt

SEQ ID NO: 559663 - DNA, 22 bp, Homo sapiens
gaggaggcaaggaagagaggga

SEQ ID NO: 559664 - DNA, 22 bp, Homo sapiens
tagctattttggggacactatt

SEQ ID NO: 559665 - DNA, 22 bp, Homo sapiens
tgtattaatgaaccaataaaac

SEQ ID NO: 559666 - DNA, 22 bp, Homo sapiens
ttttatgaggtaataatccagt

SEQ ID NO: 559667 - DNA, 22 bp, Homo sapiens
taatagtaactacctcacaggg

SEQ ID NO: 559668 - DNA, 22 bp, Homo sapiens
gcagagccagggtctgagcggg

SEQ ID NO: 559669 - DNA, 22 bp, Homo sapiens
ggaataaattgagatggattct

SEQ ID NO: 559670 - DNA, 22 bp, Homo sapiens
tccttatcatagggctgtcctt

SEQ ID NO: 559671 - DNA, 22 bp, Homo sapiens
tgaccccagtttcctctgcccc

SEQ ID NO: 559672 - DNA, 22 bp, Homo sapiens
aggagaggaggcatttaggaaa

SEQ ID NO: 559673 - DNA, 22 bp, Homo sapiens
tctagctgcagaggaccctcag

SEQ ID NO: 559674 - DNA, 22 bp, Homo sapiens
gcaggagactaagggggtgttg

SEQ ID NO: 559675 - DNA, 22 bp, Homo sapiens
ttaaaagggcttccttcaaagg

SEQ ID NO: 559676 - DNA, 22 bp, Homo sapiens
taagacatctgcactagcttga

SEQ ID NO: 559677 - DNA, 22 bp, Homo sapiens
tatccacgtatgataaaactct

SEQ ID NO: 559678 - DNA, 22 bp, Homo sapiens
attcctgatcgggtcaggcctg

SEQ ID NO: 559679 - DNA, 22 bp, Homo sapiens
ctgatgggacttgcctcccgcc

SEQ ID NO: 559680 - DNA, 22 bp, Homo sapiens
tcaaggtgggaagggctaattt

SEQ ID NO: 559681 - DNA, 22 bp, Homo sapiens
taatttgaatctatttgccctc

SEQ ID NO: 559682 - DNA, 22 bp, Homo sapiens
tagttggccttccttgagtggc

SEQ ID NO: 559683 - DNA, 22 bp, Homo sapiens
ctcccagcatgctatataggtt

SEQ ID NO: 559684 - DNA, 22 bp, Homo sapiens
agttcttttgttttctgctacc

SEQ ID NO: 559685 - DNA, 22 bp, Homo sapiens
tgttatcactgtgtgagctgaa

SEQ ID NO: 559686 - DNA, 22 bp, Homo sapiens
tggtctttagcagggcctgggc

SEQ ID NO: 559687 - DNA, 22 bp, Homo sapiens
catcctccccactcctcccacc

SEQ ID NO: 559688 - DNA, 22 bp, Homo sapiens
acagagtgtaatgagaatgcag

SEQ ID NO: 559689 - DNA, 22 bp, Homo sapiens
actccaagcattaccacctttg

SEQ ID NO: 559690 - DNA, 22 bp, Homo sapiens
taggtgttaggcagtgctggtt

SEQ ID NO: 559691 - DNA, 22 bp, Homo sapiens
agctgggatgttgatgttgtac

SEQ ID NO: 559692 - DNA, 22 bp, Homo sapiens
agtgcacatggctgaagatagt

SEQ ID NO: 559693 - DNA, 22 bp, Homo sapiens
tgaagcttagagaggcaaagta

SEQ ID NO: 559694 - DNA, 22 bp, Homo sapiens
tcagagtctgcatcaggttaga

SEQ ID NO: 559695 - DNA, 22 bp, Homo sapiens
cattgctcagtaaattgctgat

SEQ ID NO: 559696 - DNA, 22 bp, Homo sapiens
tcaggatgctcacagtccagtg

SEQ ID NO: 559697 - DNA, 22 bp, Homo sapiens
tggggaaagctggggctagatg

SEQ ID NO: 559698 - DNA, 22 bp, Homo sapiens
aaggaaaacatggggaacagag

SEQ ID NO: 559699 - DNA, 22 bp, Homo sapiens
tgtggggttctgtggatcatgt

SEQ ID NO: 559700 - DNA, 22 bp, Homo sapiens
gcagtgaccttaaaaccatgca

SEQ ID NO: 559701 - DNA, 22 bp, Homo sapiens
tgctcctggtctgtctcatgtt

SEQ ID NO: 559702 - DNA, 22 bp, Homo sapiens
tcttattcatctctgcttgcct

SEQ ID NO: 559703 - DNA, 22 bp, Homo sapiens
tcccctggtctgcagctgttag

SEQ ID NO: 559704 - DNA, 22 bp, Homo sapiens
tggcaagcacagaaatgtacat

SEQ ID NO: 559705 - DNA, 22 bp, Homo sapiens
ttagatgagtctagaatggatg

SEQ ID NO: 559706 - DNA, 22 bp, Homo sapiens
agtaaaatctttattgctggtg

SEQ ID NO: 559707 - DNA, 22 bp, Homo sapiens
tgtgagacttgttcagggtcat

SEQ ID NO: 559708 - DNA, 22 bp, Homo sapiens
atttgctgtggggcagactgtg

SEQ ID NO: 559709 - DNA, 22 bp, Homo sapiens
gcaagtggtgagggcgaggcgt

SEQ ID NO: 559710 - DNA, 22 bp, Homo sapiens
tagttgacatagcactgactgc

SEQ ID NO: 559711 - DNA, 22 bp, Homo sapiens
cagagggagggagggagaaaga

SEQ ID NO: 559712 - DNA, 22 bp, Homo sapiens
tgcacataatcaactgtgcctg

SEQ ID NO: 559713 - DNA, 22 bp, Homo sapiens
ccccggactcctggccctcctt

SEQ ID NO: 559714 - DNA, 22 bp, Homo sapiens
agggtaagttggagagggaggg

SEQ ID NO: 559715 - DNA, 22 bp, Homo sapiens
tgaggagcagagagggagcatg

SEQ ID NO: 559716 - DNA, 22 bp, Homo sapiens
tgatgttcaaagagaaacaact

SEQ ID NO: 559717 - DNA, 22 bp, Homo sapiens
agaactccctatatcccagatt

SEQ ID NO: 559718 - DNA, 22 bp, Homo sapiens
tttcagaatatgggaaaggggt

SEQ ID NO: 559719 - DNA, 22 bp, Homo sapiens
gaaagcagtgatgcatacagct

SEQ ID NO: 559720 - DNA, 22 bp, Homo sapiens
tgccatctgtaggtgttatgtg

SEQ ID NO: 559721 - DNA, 22 bp, Homo sapiens
attagcatttaatgacatgcat

SEQ ID NO: 559722 - DNA, 22 bp, Homo sapiens
cagtgggagactggtcatggat

SEQ ID NO: 559723 - DNA, 22 bp, Homo sapiens
acgttttgtggtttcgcctcat

SEQ ID NO: 559724 - DNA, 22 bp, Homo sapiens
actggttgccttttgctgagtt

SEQ ID NO: 559725 - DNA, 22 bp, Homo sapiens
cccactcctaggctggccagca

SEQ ID NO: 559726 - DNA, 22 bp, Homo sapiens
agagtgggagaatgtgccaagg

SEQ ID NO: 559727 - DNA, 22 bp, Homo sapiens
aatctgtaacatgccacaggca

SEQ ID NO: 559728 - DNA, 22 bp, Homo sapiens
gctaggagagttgtctgatttt

SEQ ID NO: 559729 - DNA, 22 bp, Homo sapiens
taaaacagttacacagagagcc

SEQ ID NO: 559730 - DNA, 22 bp, Homo sapiens
tcccactgtcctcgcaggggat

SEQ ID NO: 559731 - DNA, 22 bp, Homo sapiens
catgcataggagtttgtcacca

SEQ ID NO: 559732 - DNA, 22 bp, Homo sapiens
tgggtgtattcattcacctgct

SEQ ID NO: 559733 - DNA, 22 bp, Homo sapiens
tagcataattaagtcttatgtt

SEQ ID NO: 559734 - DNA, 22 bp, Homo sapiens
tcccagaccacagtcctttgaa

SEQ ID NO: 559735 - DNA, 22 bp, Homo sapiens
tgggcatcaagaagtcctgtca

SEQ ID NO: 559736 - DNA, 22 bp, Homo sapiens
tcggttctcttcccagtattcc

SEQ ID NO: 559737 - DNA, 22 bp, Homo sapiens
tgaggcagaggtgggaatcaca

SEQ ID NO: 559738 - DNA, 22 bp, Homo sapiens
tgatgttttggttttcactgaa

SEQ ID NO: 559739 - DNA, 22 bp, Homo sapiens
ttgcagtgatcccacacagtta

SEQ ID NO: 559740 - DNA, 22 bp, Homo sapiens
gctgttgggagttgctggaagt

SEQ ID NO: 559741 - DNA, 22 bp, Homo sapiens
tcacattttcctatagtcagct

SEQ ID NO: 559742 - DNA, 22 bp, Homo sapiens
ttgctctagctgcaaatcgttt

SEQ ID NO: 559743 - DNA, 22 bp, Homo sapiens
acagtccccttgttatcactct

SEQ ID NO: 559744 - DNA, 22 bp, Homo sapiens
aagtaactgcttagttacaagt

SEQ ID NO: 559745 - DNA, 22 bp, Homo sapiens
actaccttatacaaaatgtagg

SEQ ID NO: 559746 - DNA, 22 bp, Homo sapiens
tgtgggattgatgtaatgctta

SEQ ID NO: 559747 - DNA, 22 bp, Homo sapiens
tggctggagtgtaggtgctgga

SEQ ID NO: 559748 - DNA, 22 bp, Homo sapiens
cgaggccctctcggtcccccgc

SEQ ID NO: 559749 - DNA, 22 bp, Homo sapiens
aggagttggatggattttttat

SEQ ID NO: 559750 - DNA, 22 bp, Homo sapiens
tatgcccagagacactctctga

SEQ ID NO: 559751 - DNA, 22 bp, Homo sapiens
acctgtgccctccaccagggaa

SEQ ID NO: 559752 - DNA, 22 bp, Homo sapiens
aggaagcaaagtatttgggggg

SEQ ID NO: 559753 - DNA, 22 bp, Homo sapiens
tcttcattggctgtggctggag

SEQ ID NO: 559754 - DNA, 22 bp, Homo sapiens
tgagggtacttgaaagcagttg

SEQ ID NO: 559755 - DNA, 22 bp, Homo sapiens
tatttttggtgctggaagccag

SEQ ID NO: 559756 - DNA, 22 bp, Homo sapiens
tcttattatttcagcaggaggg

SEQ ID NO: 559757 - DNA, 22 bp, Homo sapiens
tgggaactgatgctccccagca

SEQ ID NO: 559758 - DNA, 22 bp, Homo sapiens
agggcatgggccctgtctgcag

SEQ ID NO: 559759 - DNA, 22 bp, Homo sapiens
gactattttcctgaaaattaga

SEQ ID NO: 559760 - DNA, 22 bp, Homo sapiens
tgtagtttaggtttcagaaggg

SEQ ID NO: 559761 - DNA, 22 bp, Homo sapiens
ggcccctccgagcctccgcggg

SEQ ID NO: 559762 - DNA, 22 bp, Homo sapiens
ttgatatgccagtaacatcttg

SEQ ID NO: 559763 - DNA, 22 bp, Homo sapiens
tgagaaaaagtggaaagaaggg

SEQ ID NO: 559764 - DNA, 22 bp, Homo sapiens
tccttaacctcttagtgcatct

SEQ ID NO: 559765 - DNA, 22 bp, Homo sapiens
tgctgtttttgggaaactgcag

SEQ ID NO: 559766 - DNA, 22 bp, Homo sapiens
tgattctctcatctcccagagc

SEQ ID NO: 559767 - DNA, 22 bp, Homo sapiens
ataatttagattttcttccatc

SEQ ID NO: 559768 - DNA, 22 bp, Homo sapiens
tgtgggtctggagccaatctgg

SEQ ID NO: 559769 - DNA, 22 bp, Homo sapiens
cagcaatagtttctaatgctgt

SEQ ID NO: 559770 - DNA, 22 bp, Homo sapiens
gttgagggtgggagtgggaaac

SEQ ID NO: 559771 - DNA, 22 bp, Homo sapiens
gttatctcagtcatctcggcca

SEQ ID NO: 559772 - DNA, 22 bp, Homo sapiens
tccctttcacttaactagccca

SEQ ID NO: 559773 - DNA, 22 bp, Homo sapiens
tcagtgctccctggggaagggg

SEQ ID NO: 559774 - DNA, 22 bp, Homo sapiens
gagggaagcctaggatttttgt

SEQ ID NO: 559775 - DNA, 22 bp, Homo sapiens
tgggactggcccttggctccag

SEQ ID NO: 559776 - DNA, 22 bp, Homo sapiens
tggggcggggcacctgcttctc

SEQ ID NO: 559777 - DNA, 22 bp, Homo sapiens
ttttctctctcttttgttcctg

SEQ ID NO: 559778 - DNA, 22 bp, Homo sapiens
gaactgaaggtactgtcattgt

SEQ ID NO: 559779 - DNA, 22 bp, Homo sapiens
ctggaactagcactaccagagt

SEQ ID NO: 559780 - DNA, 22 bp, Homo sapiens
aggagactgagggacagtcaag

SEQ ID NO: 559781 - DNA, 22 bp, Homo sapiens
tgcgggtggggaggcaggggcg

SEQ ID NO: 559782 - DNA, 22 bp, Homo sapiens
cctctgtgtgaggtgctctggg

SEQ ID NO: 559783 - DNA, 22 bp, Homo sapiens
ccgggaccaaggccacggagct

SEQ ID NO: 559784 - DNA, 22 bp, Homo sapiens
tcatcacgaacacaacagcgtt

SEQ ID NO: 559785 - DNA, 22 bp, Homo sapiens
aaagagaatcctgtgtgtcctg

SEQ ID NO: 559786 - DNA, 22 bp, Homo sapiens
taaaacagagtaataatgggaa

SEQ ID NO: 559787 - DNA, 22 bp, Homo sapiens
gcaccaggggatcatttagcac

SEQ ID NO: 559788 - DNA, 22 bp, Homo sapiens
tggaagggctggccaggaggga

SEQ ID NO: 559789 - DNA, 22 bp, Homo sapiens
ggataatcacactcctggggta

SEQ ID NO: 559790 - DNA, 22 bp, Homo sapiens
tcagggctgtgcacagaaggtg

SEQ ID NO: 559791 - DNA, 22 bp, Homo sapiens
cagcagaacggaaaaggctggg

SEQ ID NO: 559792 - DNA, 22 bp, Homo sapiens
tccaccgggctgaccggcctgg

SEQ ID NO: 559793 - DNA, 22 bp, Homo sapiens
tttagttatggtcgccctggta

SEQ ID NO: 559794 - DNA, 22 bp, Homo sapiens
tgtgtgtcattgagaccttggc

SEQ ID NO: 559795 - DNA, 22 bp, Homo sapiens
tcccggcgcgcgctcccctctg

SEQ ID NO: 559796 - DNA, 22 bp, Homo sapiens
ttggaagctggagatcccaggt

SEQ ID NO: 559797 - DNA, 22 bp, Homo sapiens
tggaggaagcatggaatttgga

SEQ ID NO: 559798 - DNA, 22 bp, Homo sapiens
tccgttagctatctgggttgca

SEQ ID NO: 559799 - DNA, 22 bp, Homo sapiens
tttttccatagcttgaggttac

SEQ ID NO: 559800 - DNA, 22 bp, Homo sapiens
tgatggccaggccaggggatac

SEQ ID NO: 559801 - DNA, 22 bp, Homo sapiens
tgagtgccagatgtgggggatc

SEQ ID NO: 559802 - DNA, 22 bp, Homo sapiens
taaagtccggagtgggtgtggc

SEQ ID NO: 559803 - DNA, 22 bp, Homo sapiens
tgtctctctcccttcagcttct

SEQ ID NO: 559804 - DNA, 22 bp, Homo sapiens
tgcctgctgaaagatgggatgg

SEQ ID NO: 559805 - DNA, 22 bp, Homo sapiens
tctggataggggtggagtagaa

SEQ ID NO: 559806 - DNA, 22 bp, Homo sapiens
agcaggtgagagggtataagtt

SEQ ID NO: 559807 - DNA, 22 bp, Homo sapiens
ggatgtttcatgactactctgc

SEQ ID NO: 559808 - DNA, 22 bp, Homo sapiens
ccttggctggctacctgggccg

SEQ ID NO: 559809 - DNA, 22 bp, Homo sapiens
tctggcctggggcctgctccct

SEQ ID NO: 559810 - DNA, 22 bp, Homo sapiens
tagggtgagctttgaggatgac

SEQ ID NO: 559811 - DNA, 22 bp, Homo sapiens
caggttctgcttggctctagtc

SEQ ID NO: 559812 - DNA, 22 bp, Homo sapiens
tgggaaatgaggggtgaggctt

SEQ ID NO: 559813 - DNA, 22 bp, Homo sapiens
tacataaaggaggctctttgcc

SEQ ID NO: 559814 - DNA, 22 bp, Homo sapiens
aaatagccctttgaaactgctc

SEQ ID NO: 559815 - DNA, 22 bp, Homo sapiens
tcttcgcccgtggggccccagt

SEQ ID NO: 559816 - DNA, 22 bp, Homo sapiens
tcccagcaggggacgttcttca

SEQ ID NO: 559817 - DNA, 22 bp, Homo sapiens
gtccccgtcacacaaactgtaa

SEQ ID NO: 559818 - DNA, 22 bp, Homo sapiens
gggggagctaatgggcattgct

SEQ ID NO: 559819 - DNA, 22 bp, Homo sapiens
ttagtcattttgacaagactgg

SEQ ID NO: 559820 - DNA, 22 bp, Homo sapiens
agacagaagggagggagagtgc

SEQ ID NO: 559821 - DNA, 22 bp, Homo sapiens
cagctgtgaaagccatttccag

SEQ ID NO: 559822 - DNA, 22 bp, Homo sapiens
aggcatgaaaaaggtattgctg

SEQ ID NO: 559823 - DNA, 22 bp, Homo sapiens
aaaatagtttagaattggtttt

SEQ ID NO: 559824 - DNA, 22 bp, Homo sapiens
gggacgcccttggggagcagag

SEQ ID NO: 559825 - DNA, 22 bp, Homo sapiens
cagaaaattgggaggctggagc

SEQ ID NO: 559826 - DNA, 22 bp, Homo sapiens
gggaccgagagggcctcggctg

SEQ ID NO: 559827 - DNA, 22 bp, Homo sapiens
aagatctgtaattcagcatggc

SEQ ID NO: 559828 - DNA, 22 bp, Homo sapiens
tacaggtgctgaggggctctgt

SEQ ID NO: 559829 - DNA, 22 bp, Homo sapiens
ctgtaaaatagacccaggaggt

SEQ ID NO: 559830 - DNA, 22 bp, Homo sapiens
tagtgtcccagtttgcagcctt

SEQ ID NO: 559831 - DNA, 22 bp, Homo sapiens
tttatctggtgagaaactgctg

SEQ ID NO: 559832 - DNA, 22 bp, Homo sapiens
tctttcccctgggacgttttct

SEQ ID NO: 559833 - DNA, 22 bp, Homo sapiens
tgattctctcgaactgtgcgac

SEQ ID NO: 559834 - DNA, 22 bp, Homo sapiens
aggcctctgaggagctgcgtga

SEQ ID NO: 559835 - DNA, 22 bp, Homo sapiens
ttaagccctgaagaaagagctg

SEQ ID NO: 559836 - DNA, 22 bp, Homo sapiens
ctgaaggggttctccctgtggg

SEQ ID NO: 559837 - DNA, 22 bp, Homo sapiens
accccaaatgcccttggggcag

SEQ ID NO: 559838 - DNA, 22 bp, Homo sapiens
aacacacctggttaacctcttt

SEQ ID NO: 559839 - DNA, 22 bp, Homo sapiens
ttgccacactgcaacaccttac

SEQ ID NO: 559840 - DNA, 22 bp, Homo sapiens
tttgcttttcatgcagtgaagt

SEQ ID NO: 559841 - DNA, 22 bp, Homo sapiens
tgcaaggaagctctctctgcca

SEQ ID NO: 559842 - DNA, 22 bp, Homo sapiens
taactctcatatactgtggttc

SEQ ID NO: 559843 - DNA, 22 bp, Homo sapiens
cttgcaaattatgggaccaggg

SEQ ID NO: 559844 - DNA, 22 bp, Homo sapiens
agcagagcctatggaggtatta

SEQ ID NO: 559845 - DNA, 22 bp, Homo sapiens
tggactgtctttgtttaagagc

SEQ ID NO: 559846 - DNA, 22 bp, Homo sapiens
cctcaccccagctttccaattt

SEQ ID NO: 559847 - DNA, 22 bp, Homo sapiens
gtgcagctggggaaacttaact

SEQ ID NO: 559848 - DNA, 22 bp, Homo sapiens
ttcctccctctggtgcctgagc

SEQ ID NO: 559849 - DNA, 22 bp, Homo sapiens
tacaacacttttaatatgcatt

SEQ ID NO: 559850 - DNA, 22 bp, Homo sapiens
gaccgcatgctaagttgggccc

SEQ ID NO: 559851 - DNA, 22 bp, Homo sapiens
tgtccttgcccgatgtccctcc

SEQ ID NO: 559852 - DNA, 22 bp, Homo sapiens
tgccccctatagattttaagac

SEQ ID NO: 559853 - DNA, 22 bp, Homo sapiens
taatgcaaaaagaaaacattct

SEQ ID NO: 559854 - DNA, 22 bp, Homo sapiens
tgaagaagtaataggtggtgat

SEQ ID NO: 559855 - DNA, 22 bp, Homo sapiens
gaagggggggcagtgcatgtgt

SEQ ID NO: 559856 - DNA, 22 bp, Homo sapiens
gcccttctgaagagttgagcat

SEQ ID NO: 559857 - DNA, 22 bp, Homo sapiens
tactctgtgggagggaggagat

SEQ ID NO: 559858 - DNA, 22 bp, Homo sapiens
ttaagcaataagttagatgtca

SEQ ID NO: 559859 - DNA, 22 bp, Homo sapiens
attttgcttcatgtcttttgct

SEQ ID NO: 559860 - DNA, 22 bp, Homo sapiens
ggggagaaggcacaacacagct

SEQ ID NO: 559861 - DNA, 22 bp, Homo sapiens
taattgtcctaatgcactctgc

SEQ ID NO: 559862 - DNA, 22 bp, Homo sapiens
tgagaagattttaatctgaggt

SEQ ID NO: 559863 - DNA, 22 bp, Homo sapiens
ctctcattgattttcactgccc

SEQ ID NO: 559864 - DNA, 22 bp, Homo sapiens
tgtgagtgataggaaatacagg

SEQ ID NO: 559865 - DNA, 22 bp, Homo sapiens
tcagtttgcaagtttgttgggt

SEQ ID NO: 559866 - DNA, 22 bp, Homo sapiens
gaggtggctagagagctggtca

SEQ ID NO: 559867 - DNA, 22 bp, Homo sapiens
tgtagtccatatttcaattaat

SEQ ID NO: 559868 - DNA, 22 bp, Homo sapiens
tgatgtcctggggggttgggac

SEQ ID NO: 559869 - DNA, 22 bp, Homo sapiens
tttctcccttcccaagacctga

SEQ ID NO: 559870 - DNA, 22 bp, Homo sapiens
tgggggaaagggacttgcctgt

SEQ ID NO: 559871 - DNA, 22 bp, Homo sapiens
aatgggtcaagccagtgctctt

SEQ ID NO: 559872 - DNA, 22 bp, Homo sapiens
aatgggacaagatgagatgaca

SEQ ID NO: 559873 - DNA, 22 bp, Homo sapiens
agacttggtgagctggtaggaa

SEQ ID NO: 559874 - DNA, 22 bp, Homo sapiens
ggggggaggctggaaatgttct

SEQ ID NO: 559875 - DNA, 22 bp, Homo sapiens
tttcccatctatcttctacctt

SEQ ID NO: 559876 - DNA, 22 bp, Homo sapiens
aggtgtttctgttcttcagaga

SEQ ID NO: 559877 - DNA, 22 bp, Homo sapiens
ccatcaatgactaataaaatag

SEQ ID NO: 559878 - DNA, 22 bp, Homo sapiens
atgattgttctctccttgcgca

SEQ ID NO: 559879 - DNA, 22 bp, Homo sapiens
ccccagaggctgggtgcagggg

SEQ ID NO: 559880 - DNA, 22 bp, Homo sapiens
tttccttttgggatcttgatgg

SEQ ID NO: 559881 - DNA, 22 bp, Homo sapiens
tagagatagctgcagccaccta

SEQ ID NO: 559882 - DNA, 22 bp, Homo sapiens
cgttttaagatcgagatataaa

SEQ ID NO: 559883 - DNA, 22 bp, Homo sapiens
tattgtgtttttgatggagtgt

SEQ ID NO: 559884 - DNA, 22 bp, Homo sapiens
tgaaagggggtcttggaacagg

SEQ ID NO: 559885 - DNA, 22 bp, Homo sapiens
tgttctccttgtttttccattc

SEQ ID NO: 559886 - DNA, 22 bp, Homo sapiens
agtcccaaggatgtgattatct

SEQ ID NO: 559887 - DNA, 22 bp, Homo sapiens
ggtgctctccgctccctgcttc

SEQ ID NO: 559888 - DNA, 22 bp, Homo sapiens
ttctacctccacctgtatcatc

SEQ ID NO: 559889 - DNA, 22 bp, Homo sapiens
actcagttttcgcaggatccct

SEQ ID NO: 559890 - DNA, 22 bp, Homo sapiens
gaaggtgggggctggatgcttt

SEQ ID NO: 559891 - DNA, 22 bp, Homo sapiens
cccactttcaccacctggcctc

SEQ ID NO: 559892 - DNA, 22 bp, Homo sapiens
ctctgtactcagtgcctccgtt

SEQ ID NO: 559893 - DNA, 22 bp, Homo sapiens
cgcctccctactggcctttgca

SEQ ID NO: 559894 - DNA, 22 bp, Homo sapiens
tggaatggatttccctaagtgg

SEQ ID NO: 559895 - DNA, 22 bp, Homo sapiens
gacaaattgcacaggaggcatt

SEQ ID NO: 559896 - DNA, 22 bp, Homo sapiens
tcaatgagggaaggacagagga

SEQ ID NO: 559897 - DNA, 22 bp, Homo sapiens
tcagaggcttattcatctcatc

SEQ ID NO: 559898 - DNA, 22 bp, Homo sapiens
cttggccccgtggcgctctgta

SEQ ID NO: 559899 - DNA, 22 bp, Homo sapiens
caagcatgggctttgacatcag

SEQ ID NO: 559900 - DNA, 22 bp, Homo sapiens
taacgtttactgagcacttact

SEQ ID NO: 559901 - DNA, 22 bp, Homo sapiens
ttatccccaggcagagagctca

SEQ ID NO: 559902 - DNA, 22 bp, Homo sapiens
tcagatgatgtcaggcccagtt

SEQ ID NO: 559903 - DNA, 22 bp, Homo sapiens
tagaaagagggtatgagtaata

SEQ ID NO: 559904 - DNA, 22 bp, Homo sapiens
ttgcctgtgttctcttctcttt

SEQ ID NO: 559905 - DNA, 22 bp, Homo sapiens
aggtggtgactgttgtgggcat

SEQ ID NO: 559906 - DNA, 22 bp, Homo sapiens
gaaggtgaagagcttcctgcgg

SEQ ID NO: 559907 - DNA, 22 bp, Homo sapiens
tcaccatcacccggtgctgggc

SEQ ID NO: 559908 - DNA, 22 bp, Homo sapiens
ggcgtgggaggacctaggcctg

SEQ ID NO: 559909 - DNA, 22 bp, Homo sapiens
ggctgatctgcatacatatttt

SEQ ID NO: 559910 - DNA, 22 bp, Homo sapiens
ttccctttcatgtggctgcctg

SEQ ID NO: 559911 - DNA, 22 bp, Homo sapiens
tttttcatttacaaatatggtg

SEQ ID NO: 559912 - DNA, 22 bp, Homo sapiens
accctggtcccctggcctctgt

SEQ ID NO: 559913 - DNA, 22 bp, Homo sapiens
ttgggaatagttgagggtttag

SEQ ID NO: 559914 - DNA, 22 bp, Homo sapiens
tgccgcttggtgctgggctagt

SEQ ID NO: 559915 - DNA, 22 bp, Homo sapiens
taaaaaccaagcatgctttttg

SEQ ID NO: 559916 - DNA, 22 bp, Homo sapiens
tctgggccaggcgagccgaggg

SEQ ID NO: 559917 - DNA, 22 bp, Homo sapiens
gaagaggcagagacagtttggg

SEQ ID NO: 559918 - DNA, 22 bp, Homo sapiens
gagtgttctagaaactgctctt

SEQ ID NO: 559919 - DNA, 22 bp, Homo sapiens
tttgttaatgctgcttttaaca

SEQ ID NO: 559920 - DNA, 22 bp, Homo sapiens
agcgggtgtttatcatttaaaa

SEQ ID NO: 559921 - DNA, 22 bp, Homo sapiens
ctcaggcagtggtatggatggg

SEQ ID NO: 559922 - DNA, 22 bp, Homo sapiens
atagtatgtctagtctttaggt

SEQ ID NO: 559923 - DNA, 22 bp, Homo sapiens
tttatgactatgtcattcataa

SEQ ID NO: 559924 - DNA, 22 bp, Homo sapiens
ccctgggcgctcagcagttctg

SEQ ID NO: 559925 - DNA, 22 bp, Homo sapiens
tgccccactgaagatggcttcc

SEQ ID NO: 559926 - DNA, 22 bp, Homo sapiens
ggcccctggattcttagaactc

SEQ ID NO: 559927 - DNA, 22 bp, Homo sapiens
aacactcactgggaccagccaa

SEQ ID NO: 559928 - DNA, 22 bp, Homo sapiens
tccctttgtgaggggaaaaaaa

SEQ ID NO: 559929 - DNA, 22 bp, Homo sapiens
gccattttaaggttggaagcag

SEQ ID NO: 559930 - DNA, 22 bp, Homo sapiens
cagcagtccaggtgtgatcctg

SEQ ID NO: 559931 - DNA, 22 bp, Homo sapiens
ggggaggttctagagggacagg

SEQ ID NO: 559932 - DNA, 22 bp, Homo sapiens
tactccttctgtcctgtggtag

SEQ ID NO: 559933 - DNA, 22 bp, Homo sapiens
cctgtgaggagttgggttcggc

SEQ ID NO: 559934 - DNA, 22 bp, Homo sapiens
aaagtgctgtcatagctgaggt

SEQ ID NO: 559935 - DNA, 22 bp, Homo sapiens
tcaatttgacaaggttctttct

SEQ ID NO: 559936 - DNA, 22 bp, Homo sapiens
ctggtgccttgctgcaagggaa

SEQ ID NO: 559937 - DNA, 22 bp, Homo sapiens
ttggatcaggatgaatggtagc

SEQ ID NO: 559938 - DNA, 22 bp, Homo sapiens
actcatcaacttgtttttttgc

SEQ ID NO: 559939 - DNA, 22 bp, Homo sapiens
aattttgagtttgtttgatgag

SEQ ID NO: 559940 - DNA, 22 bp, Homo sapiens
aggttggaattcttttgagcag

SEQ ID NO: 559941 - DNA, 22 bp, Homo sapiens
cctctgaagctcttccattttg

SEQ ID NO: 559942 - DNA, 22 bp, Homo sapiens
gggtcccagcctgccctgctgg

SEQ ID NO: 559943 - DNA, 22 bp, Homo sapiens
ctgaggttatggtgttagacta

SEQ ID NO: 559944 - DNA, 22 bp, Homo sapiens
ggatgataggatagggaaggga

SEQ ID NO: 559945 - DNA, 22 bp, Homo sapiens
tttgttgcctttctggccgcat

SEQ ID NO: 559946 - DNA, 22 bp, Homo sapiens
ttctgtgttctgcgtttaatgc

SEQ ID NO: 559947 - DNA, 22 bp, Homo sapiens
gcttggagctcctgctaccatg

SEQ ID NO: 559948 - DNA, 22 bp, Homo sapiens
gtctctctttcctcctcaggaa

SEQ ID NO: 559949 - DNA, 22 bp, Homo sapiens
gagtgggagcaagggtgatttg

SEQ ID NO: 559950 - DNA, 22 bp, Homo sapiens
agcattttctgcctgggtgcta

SEQ ID NO: 559951 - DNA, 22 bp, Homo sapiens
aaagtagatggatttagtccag

SEQ ID NO: 559952 - DNA, 22 bp, Homo sapiens
cacagcaactgaatatattgct

SEQ ID NO: 559953 - DNA, 22 bp, Homo sapiens
gggcttcacttatctcatcctt

SEQ ID NO: 559954 - DNA, 22 bp, Homo sapiens
gggtttgtggttcttctgcgcc

SEQ ID NO: 559955 - DNA, 22 bp, Homo sapiens
taggagtcagtcactcctatct

SEQ ID NO: 559956 - DNA, 22 bp, Homo sapiens
cttcacaattcctatggtaacc

SEQ ID NO: 559957 - DNA, 22 bp, Homo sapiens
tgaaaggcaaaggcagccacat

SEQ ID NO: 559958 - DNA, 22 bp, Homo sapiens
tcagagatggaaagcagaccac

SEQ ID NO: 559959 - DNA, 22 bp, Homo sapiens
cctcccagaaactccacaccca

SEQ ID NO: 559960 - DNA, 22 bp, Homo sapiens
tgacttgatgaaagggctgcac

SEQ ID NO: 559961 - DNA, 22 bp, Homo sapiens
agttgccatagagccacttccc

SEQ ID NO: 559962 - DNA, 22 bp, Homo sapiens
gccacagatttgaccactccag

SEQ ID NO: 559963 - DNA, 22 bp, Homo sapiens
tgtgagaatgtgtaatgtgtgt

SEQ ID NO: 559964 - DNA, 22 bp, Homo sapiens
gggtggctgcagggggtggtat

SEQ ID NO: 559965 - DNA, 22 bp, Homo sapiens
ctaaagtactttacatatatta

SEQ ID NO: 559966 - DNA, 22 bp, Homo sapiens
attctgagaataacataaatgc

SEQ ID NO: 559967 - DNA, 22 bp, Homo sapiens
gcctcagctgccacacctccac

SEQ ID NO: 559968 - DNA, 22 bp, Homo sapiens
ccaaggatgattctaaaggagg

SEQ ID NO: 559969 - DNA, 22 bp, Homo sapiens
catttaggagaccagaataaga

SEQ ID NO: 559970 - DNA, 22 bp, Homo sapiens
caaagggagggatggaggccct

SEQ ID NO: 559971 - DNA, 22 bp, Homo sapiens
tggcctgtttttattctgtttg

SEQ ID NO: 559972 - DNA, 22 bp, Homo sapiens
ttcttaaacaccaaaggatgtg

SEQ ID NO: 559973 - DNA, 22 bp, Homo sapiens
gagctcctgggcctggtggagc

SEQ ID NO: 559974 - DNA, 22 bp, Homo sapiens
tgctcagaaaggtcagcatgag

SEQ ID NO: 559975 - DNA, 22 bp, Homo sapiens
tcactgtaatgagggagaaggg

SEQ ID NO: 559976 - DNA, 22 bp, Homo sapiens
agtgttttgtacaatttcttgt

SEQ ID NO: 559977 - DNA, 22 bp, Homo sapiens
ggttcatcaataactcagagaa

SEQ ID NO: 559978 - DNA, 22 bp, Homo sapiens
gggaaggaggctccagggcttt

SEQ ID NO: 559979 - DNA, 22 bp, Homo sapiens
cgtgggcgatgttgcagggagc

SEQ ID NO: 559980 - DNA, 22 bp, Homo sapiens
cccatggtggctccaagtgccc

SEQ ID NO: 559981 - DNA, 22 bp, Homo sapiens
cagttcacagacctagatttag

SEQ ID NO: 559982 - DNA, 22 bp, Homo sapiens
tccaagacacataggagctgaa

SEQ ID NO: 559983 - DNA, 22 bp, Homo sapiens
tcccatgaggcgtgtccctggg

SEQ ID NO: 559984 - DNA, 22 bp, Homo sapiens
tgcctcttttctggggggaaaa

SEQ ID NO: 559985 - DNA, 22 bp, Homo sapiens
actggagagatgcctgcgtgga

SEQ ID NO: 559986 - DNA, 22 bp, Homo sapiens
cctccttctcagccccagctcc

SEQ ID NO: 559987 - DNA, 22 bp, Homo sapiens
gaggttggggtatgtttccgga

SEQ ID NO: 559988 - DNA, 22 bp, Homo sapiens
tactggagggagggatggtggt

SEQ ID NO: 559989 - DNA, 22 bp, Homo sapiens
ctaaaggcaatgagattgggtg

SEQ ID NO: 559990 - DNA, 22 bp, Homo sapiens
gggaggagcgttcaccctttcc

SEQ ID NO: 559991 - DNA, 22 bp, Homo sapiens
tcctgagacttccgccagcccc

SEQ ID NO: 559992 - DNA, 22 bp, Homo sapiens
ttttctttgtccagacagctct

SEQ ID NO: 559993 - DNA, 22 bp, Homo sapiens
tagaaaagctagttgctaaaaa

SEQ ID NO: 559994 - DNA, 22 bp, Homo sapiens
tgcacaatcctgtgagtgagtc

SEQ ID NO: 559995 - DNA, 22 bp, Homo sapiens
cagaaatcagattcttggccag

SEQ ID NO: 559996 - DNA, 22 bp, Homo sapiens
tatcttatggctaaggtcgggg

SEQ ID NO: 559997 - DNA, 22 bp, Homo sapiens
tttaatgtttttatgcagttta

SEQ ID NO: 559998 - DNA, 22 bp, Homo sapiens
tgtggcctgtggtcaagtcaga

SEQ ID NO: 559999 - DNA, 22 bp, Homo sapiens
cacgctgcagcctggggaaggc

SEQ ID NO: 560000 - DNA, 22 bp, Homo sapiens
ggaagtagcctggatgtgcata

SEQ ID NO: 560001 - DNA, 22 bp, Homo sapiens
ggctgtgtcactgtgggcatag

SEQ ID NO: 560002 - DNA, 22 bp, Homo sapiens
tccacagtggtggaattgttca

SEQ ID NO: 560003 - DNA, 22 bp, Homo sapiens
agcctggtgcatttgaagaaca

SEQ ID NO: 560004 - DNA, 22 bp, Homo sapiens
tgaggtgcctacgctgaaatgg

SEQ ID NO: 560005 - DNA, 22 bp, Homo sapiens
agattaaccctaccatccatcc

SEQ ID NO: 560006 - DNA, 22 bp, Homo sapiens
ttgttttccaagctgtcccatt

SEQ ID NO: 560007 - DNA, 22 bp, Homo sapiens
gttgtgtgtggtgtgtttatcc

SEQ ID NO: 560008 - DNA, 22 bp, Homo sapiens
tccttataatgccctaaggatg

SEQ ID NO: 560009 - DNA, 22 bp, Homo sapiens
gctttcaagttaagtggggcct

SEQ ID NO: 560010 - DNA, 22 bp, Homo sapiens
tggggagaaggagctgtggtgg

SEQ ID NO: 560011 - DNA, 22 bp, Homo sapiens
agggtactggaagagtgtgccc

SEQ ID NO: 560012 - DNA, 22 bp, Homo sapiens
tcaatcataatgttacatgata

SEQ ID NO: 560013 - DNA, 22 bp, Homo sapiens
ttcagtgggcagtgaacactcc

SEQ ID NO: 560014 - DNA, 22 bp, Homo sapiens
taagcgcgatgccctctcctag

SEQ ID NO: 560015 - DNA, 22 bp, Homo sapiens
tcgtcgtagtggaggtgcagca

SEQ ID NO: 560016 - DNA, 22 bp, Homo sapiens
acagctgcaagtgttgcctcct

SEQ ID NO: 560017 - DNA, 22 bp, Homo sapiens
tgcttgtgggatctccccgttg

SEQ ID NO: 560018 - DNA, 22 bp, Homo sapiens
cctctctcgctaaccaggtgat

SEQ ID NO: 560019 - DNA, 22 bp, Homo sapiens
ctggttctgcacttggtcctga

SEQ ID NO: 560020 - DNA, 22 bp, Homo sapiens
ctttctggactcttgggtccta

SEQ ID NO: 560021 - DNA, 22 bp, Homo sapiens
ttgctaatgtgcataggaattc

SEQ ID NO: 560022 - DNA, 22 bp, Homo sapiens
accggctaccccgcccccacac

SEQ ID NO: 560023 - DNA, 22 bp, Homo sapiens
aactgaggcacggtgagaggca

SEQ ID NO: 560024 - DNA, 22 bp, Homo sapiens
tgctctgcactcaactgatggt

SEQ ID NO: 560025 - DNA, 22 bp, Homo sapiens
tatggacaggaaagtaacatta

SEQ ID NO: 560026 - DNA, 22 bp, Homo sapiens
cctctgacccttttggtcgcta

SEQ ID NO: 560027 - DNA, 22 bp, Homo sapiens
aattggctccatttcagacccc

SEQ ID NO: 560028 - DNA, 22 bp, Homo sapiens
gtagttgctgctctgaaagagg

SEQ ID NO: 560029 - DNA, 22 bp, Homo sapiens
cagtaggagcagggctgggcag

SEQ ID NO: 560030 - DNA, 22 bp, Homo sapiens
ctggctccacaggccagggtgt

SEQ ID NO: 560031 - DNA, 22 bp, Homo sapiens
tgggaagaaagcctggtgatac

SEQ ID NO: 560032 - DNA, 22 bp, Homo sapiens
ctcacacctgtcttgtgttctt

SEQ ID NO: 560033 - DNA, 22 bp, Homo sapiens
tagccacatcttctgaaaattc

SEQ ID NO: 560034 - DNA, 22 bp, Homo sapiens
tctacaaaggaaagcgctttct

SEQ ID NO: 560035 - DNA, 22 bp, Homo sapiens
ctgtttctttgatttcttgttt

SEQ ID NO: 560036 - DNA, 22 bp, Homo sapiens
cctgtgtgtgttttgccccagg

SEQ ID NO: 560037 - DNA, 22 bp, Homo sapiens
tgtgacctctggcctctcccaa

SEQ ID NO: 560038 - DNA, 22 bp, Homo sapiens
caatctgcttctcaagccacca

SEQ ID NO: 560039 - DNA, 22 bp, Homo sapiens
ttctttcctcccacaggaagtc

SEQ ID NO: 560040 - DNA, 22 bp, Homo sapiens
tagtttttattggtctgaatgg

SEQ ID NO: 560041 - DNA, 22 bp, Homo sapiens
tgacctttgaacagcccaggga

SEQ ID NO: 560042 - DNA, 22 bp, Homo sapiens
cccccacaccggccccaccacc

SEQ ID NO: 560043 - DNA, 22 bp, Homo sapiens
gaatggattatggaaaggtctc

SEQ ID NO: 560044 - DNA, 22 bp, Homo sapiens
tctgtttgggaagggtgttcag

SEQ ID NO: 560045 - DNA, 22 bp, Homo sapiens
cctgcgcttcctcttgcacttc

SEQ ID NO: 560046 - DNA, 22 bp, Homo sapiens
tctgggcgtagtagtgacgaat

SEQ ID NO: 560047 - DNA, 22 bp, Homo sapiens
tgaactgtaaaatctgatttct

SEQ ID NO: 560048 - DNA, 22 bp, Homo sapiens
agggggcagctctaaccctaaa

SEQ ID NO: 560049 - DNA, 22 bp, Homo sapiens
tggaaaactgaaagctgacctt

SEQ ID NO: 560050 - DNA, 22 bp, Homo sapiens
gaatctctacgggtaagtgtgt

SEQ ID NO: 560051 - DNA, 22 bp, Homo sapiens
gagctagactttgtcaggaggc

SEQ ID NO: 560052 - DNA, 22 bp, Homo sapiens
ggtgctcttattcgccacattt

SEQ ID NO: 560053 - DNA, 22 bp, Homo sapiens
ccggcatagaaactgggccgag

SEQ ID NO: 560054 - DNA, 22 bp, Homo sapiens
taggagctggtgtgttgctgta

SEQ ID NO: 560055 - DNA, 22 bp, Homo sapiens
ttccctgaatgctttcctgttt

SEQ ID NO: 560056 - DNA, 22 bp, Homo sapiens
ctatggcactcttaatccgtac

SEQ ID NO: 560057 - DNA, 22 bp, Homo sapiens
gaggggctgggctgggctgggc

SEQ ID NO: 560058 - DNA, 22 bp, Homo sapiens
tttcatgtttctattggatgga

SEQ ID NO: 560059 - DNA, 22 bp, Homo sapiens
ttttatctgttcttcagtctgt

SEQ ID NO: 560060 - DNA, 22 bp, Homo sapiens
gcctggtgtcccgccatgaacg

SEQ ID NO: 560061 - DNA, 22 bp, Homo sapiens
tggtaccatggggaccccaaag

SEQ ID NO: 560062 - DNA, 22 bp, Homo sapiens
tcctctctttccatgatcatgt

SEQ ID NO: 560063 - DNA, 22 bp, Homo sapiens
tagatgtctgaccaccttctgg

SEQ ID NO: 560064 - DNA, 22 bp, Homo sapiens
caaatgtttctgaatatccaca

SEQ ID NO: 560065 - DNA, 22 bp, Homo sapiens
tgagggagggcacctgaccttg

SEQ ID NO: 560066 - DNA, 22 bp, Homo sapiens
accagtttctacctggcagcac

SEQ ID NO: 560067 - DNA, 22 bp, Homo sapiens
tgaacacaatgtgctctgtgta

SEQ ID NO: 560068 - DNA, 22 bp, Homo sapiens
gttttttttaaatttgttacag

SEQ ID NO: 560069 - DNA, 22 bp, Homo sapiens
ggggaggggcaaacaggttgga

SEQ ID NO: 560070 - DNA, 22 bp, Homo sapiens
agggatctggggagggaggagg

SEQ ID NO: 560071 - DNA, 22 bp, Homo sapiens
aaccaggaccttcagctaagta

SEQ ID NO: 560072 - DNA, 22 bp, Homo sapiens
cagtgatgtatacagcaggggt

SEQ ID NO: 560073 - DNA, 22 bp, Homo sapiens
actcagccttgagggcactttc

SEQ ID NO: 560074 - DNA, 22 bp, Homo sapiens
acaatctgaaagatgactgctg

SEQ ID NO: 560075 - DNA, 22 bp, Homo sapiens
tggcttttcattataaattttg

SEQ ID NO: 560076 - DNA, 22 bp, Homo sapiens
agtgattgaaaggacgtttaga

SEQ ID NO: 560077 - DNA, 22 bp, Homo sapiens
tccactctgctccgtccgccca

SEQ ID NO: 560078 - DNA, 22 bp, Homo sapiens
tacttgtgtatctagggagatg

SEQ ID NO: 560079 - DNA, 22 bp, Homo sapiens
tttatctcatgagtcgataaat

SEQ ID NO: 560080 - DNA, 22 bp, Homo sapiens
cactccttccctaccttttttt

SEQ ID NO: 560081 - DNA, 22 bp, Homo sapiens
aactgtccttcctggaggtgta

SEQ ID NO: 560082 - DNA, 22 bp, Homo sapiens
tgccaatttgcccctttgctga

SEQ ID NO: 560083 - DNA, 22 bp, Homo sapiens
ttacaccactcccaggaagaat

SEQ ID NO: 560084 - DNA, 22 bp, Homo sapiens
cctggtgccttctggttcgctg

SEQ ID NO: 560085 - DNA, 22 bp, Homo sapiens
cagtggcctcaggccctctgcc

SEQ ID NO: 560086 - DNA, 22 bp, Homo sapiens
acttcttcttccctgtctcttc

SEQ ID NO: 560087 - DNA, 22 bp, Homo sapiens
tgggaggcagattgttgagtca

SEQ ID NO: 560088 - DNA, 22 bp, Homo sapiens
attcatgtatagctgtttcaga

SEQ ID NO: 560089 - DNA, 22 bp, Homo sapiens
tatgcaattatccattttgcat

SEQ ID NO: 560090 - DNA, 22 bp, Homo sapiens
ccttgtcagtaggaaccctgat

SEQ ID NO: 560091 - DNA, 22 bp, Homo sapiens
tgcttgatgccaagcatcctga

SEQ ID NO: 560092 - DNA, 22 bp, Homo sapiens
tttgcatgttgggctcatcctc

SEQ ID NO: 560093 - DNA, 22 bp, Homo sapiens
agccagagttcatcagttaagg

SEQ ID NO: 560094 - DNA, 22 bp, Homo sapiens
tcaggtcttcatttgacttact

SEQ ID NO: 560095 - DNA, 22 bp, Homo sapiens
gaaggatgtgtcactctcagga

SEQ ID NO: 560096 - DNA, 22 bp, Homo sapiens
tctttttttttgctggaacatt

SEQ ID NO: 560097 - DNA, 22 bp, Homo sapiens
acttgaggcaaatagtaatggc

SEQ ID NO: 560098 - DNA, 22 bp, Homo sapiens
gggagcagcagtcagtcaccat

SEQ ID NO: 560099 - DNA, 22 bp, Homo sapiens
ctgatgggttggaagtgggatg

SEQ ID NO: 560100 - DNA, 22 bp, Homo sapiens
tgggggaggaggtcagtgaggc

SEQ ID NO: 560101 - DNA, 22 bp, Homo sapiens
ttctgtgggcgggtacaaacac

SEQ ID NO: 560102 - DNA, 22 bp, Homo sapiens
ggagggacagaaggaggcaggg

SEQ ID NO: 560103 - DNA, 22 bp, Homo sapiens
cggtgagaaggggtgttgtctg

SEQ ID NO: 560104 - DNA, 22 bp, Homo sapiens
tggctttatgtatcatctccac

SEQ ID NO: 560105 - DNA, 22 bp, Homo sapiens
tgcacctgtctctcattcccat

SEQ ID NO: 560106 - DNA, 22 bp, Homo sapiens
ttctgcctgtagatggttcctg

SEQ ID NO: 560107 - DNA, 22 bp, Homo sapiens
attaagatccagaagcaagaca

SEQ ID NO: 560108 - DNA, 22 bp, Homo sapiens
agggttcatggaattataggag

SEQ ID NO: 560109 - DNA, 22 bp, Homo sapiens
ttctcctggagggcgacttttt

SEQ ID NO: 560110 - DNA, 22 bp, Homo sapiens
gtagttggtggggggaggtagt

SEQ ID NO: 560111 - DNA, 22 bp, Homo sapiens
tcccaggagacaggcataggac

SEQ ID NO: 560112 - DNA, 22 bp, Homo sapiens
tgtcctttgtcctgaggcacac

SEQ ID NO: 560113 - DNA, 22 bp, Homo sapiens
cctaggcctgggggaggggaag

SEQ ID NO: 560114 - DNA, 22 bp, Homo sapiens
ggcacgcagaggaggaagaggg

SEQ ID NO: 560115 - DNA, 22 bp, Homo sapiens
tattctcctctgtattgtttga

SEQ ID NO: 560116 - DNA, 22 bp, Homo sapiens
taggctgacagggactacacct

SEQ ID NO: 560117 - DNA, 22 bp, Homo sapiens
cttggttttacaagtatggagg

SEQ ID NO: 560118 - DNA, 22 bp, Homo sapiens
taatctgggatatttattaggt

SEQ ID NO: 560119 - DNA, 22 bp, Homo sapiens
cccagagcatgcagtgtgaaca

SEQ ID NO: 560120 - DNA, 22 bp, Homo sapiens
cataagctagcctgcctgcaca

SEQ ID NO: 560121 - DNA, 22 bp, Homo sapiens
tggggggtgagcagcccctcgg

SEQ ID NO: 560122 - DNA, 22 bp, Homo sapiens
tgtcctttgtgcagaacagtaa

SEQ ID NO: 560123 - DNA, 22 bp, Homo sapiens
tcagacatctgttcctggttga

SEQ ID NO: 560124 - DNA, 22 bp, Homo sapiens
aaacagatctgacttggctctg

SEQ ID NO: 560125 - DNA, 22 bp, Homo sapiens
aaagacaatagcagaaagccag

SEQ ID NO: 560126 - DNA, 22 bp, Homo sapiens
tctgcagaggccctactgtgca

SEQ ID NO: 560127 - DNA, 22 bp, Homo sapiens
gagagggaaaggctttggagtc

SEQ ID NO: 560128 - DNA, 22 bp, Homo sapiens
tggttctgtataatgtaaggaa

SEQ ID NO: 560129 - DNA, 22 bp, Homo sapiens
tgtggccatcgctgccccctcg

SEQ ID NO: 560130 - DNA, 22 bp, Homo sapiens
ggctccttaaactaatatttgc

SEQ ID NO: 560131 - DNA, 22 bp, Homo sapiens
tgagctgtggaataatgccttc

SEQ ID NO: 560132 - DNA, 22 bp, Homo sapiens
tgggtcacagagcagatggtcc

SEQ ID NO: 560133 - DNA, 22 bp, Homo sapiens
cctgctggcccaggcccctcgc

SEQ ID NO: 560134 - DNA, 22 bp, Homo sapiens
cctatagctattttctccctct

SEQ ID NO: 560135 - DNA, 22 bp, Homo sapiens
tgtgaagggcgggagactggga

SEQ ID NO: 560136 - DNA, 22 bp, Homo sapiens
tcatcccttccagtctctgtgg

SEQ ID NO: 560137 - DNA, 22 bp, Homo sapiens
ggcggggagggagctgtggctt

SEQ ID NO: 560138 - DNA, 22 bp, Homo sapiens
tcctcattcttgcatccctgaa

SEQ ID NO: 560139 - DNA, 22 bp, Homo sapiens
tggtgtggtgtcgagctaggaa

SEQ ID NO: 560140 - DNA, 22 bp, Homo sapiens
gatggtgttgagtttggtactc

SEQ ID NO: 560141 - DNA, 22 bp, Homo sapiens
tgcctctcccagcctcatttga

SEQ ID NO: 560142 - DNA, 22 bp, Homo sapiens
tctttatagcatacattgacta

SEQ ID NO: 560143 - DNA, 22 bp, Homo sapiens
ttttcacagcagtgtgctgctt

SEQ ID NO: 560144 - DNA, 22 bp, Homo sapiens
aggggagggggtctttggggag

SEQ ID NO: 560145 - DNA, 22 bp, Homo sapiens
ggtaacaaagagcaagagaagt

SEQ ID NO: 560146 - DNA, 22 bp, Homo sapiens
tggggtcttggagaggcagtcc

SEQ ID NO: 560147 - DNA, 22 bp, Homo sapiens
gatcctctcctggctcagcttt

SEQ ID NO: 560148 - DNA, 22 bp, Homo sapiens
tttattggttgagaatcagtac

SEQ ID NO: 560149 - DNA, 22 bp, Homo sapiens
taatggtgtggaataactattt

SEQ ID NO: 560150 - DNA, 22 bp, Homo sapiens
tcatgtgtgacccaaactgctg

SEQ ID NO: 560151 - DNA, 22 bp, Homo sapiens
aaacatatatatttgcatctac

SEQ ID NO: 560152 - DNA, 22 bp, Homo sapiens
tacttgtaactataaaagatgt

SEQ ID NO: 560153 - DNA, 22 bp, Homo sapiens
tcagagagcacagcatatcggg

SEQ ID NO: 560154 - DNA, 22 bp, Homo sapiens
ggcagggggcctggctgggaaa

SEQ ID NO: 560155 - DNA, 22 bp, Homo sapiens
tgaaatgaatgtgattcgatag

SEQ ID NO: 560156 - DNA, 22 bp, Homo sapiens
tatttccagtctccattctttt

SEQ ID NO: 560157 - DNA, 22 bp, Homo sapiens
ggcttttgtcctgtggggcaat

SEQ ID NO: 560158 - DNA, 22 bp, Homo sapiens
ccaggtagtggtctgtggctac

SEQ ID NO: 560159 - DNA, 22 bp, Homo sapiens
ctgccctgtcgcctccctgtcc

SEQ ID NO: 560160 - DNA, 22 bp, Homo sapiens
taccctggtgcgtggggccgca

SEQ ID NO: 560161 - DNA, 22 bp, Homo sapiens
gcttgggaggtgatgaggagaa

SEQ ID NO: 560162 - DNA, 22 bp, Homo sapiens
ttcttcccttctctgcaggggc

SEQ ID NO: 560163 - DNA, 22 bp, Homo sapiens
aatgacctatataattctttct

SEQ ID NO: 560164 - DNA, 22 bp, Homo sapiens
tttctgctctccttcccatttc

SEQ ID NO: 560165 - DNA, 22 bp, Homo sapiens
accccagtgccctttcctttct

SEQ ID NO: 560166 - DNA, 22 bp, Homo sapiens
taacagaaaattgactctgcaa

SEQ ID NO: 560167 - DNA, 22 bp, Homo sapiens
ttccctttgtgccttcgattct

SEQ ID NO: 560168 - DNA, 22 bp, Homo sapiens
tttggattgtgtcatcagctcc

SEQ ID NO: 560169 - DNA, 22 bp, Homo sapiens
tgctctggcccagagcgcatgt

SEQ ID NO: 560170 - DNA, 22 bp, Homo sapiens
cacagtggcccggtggcctcac

SEQ ID NO: 560171 - DNA, 22 bp, Homo sapiens
tgcgtgtgtgatatgcctctgc

SEQ ID NO: 560172 - DNA, 22 bp, Homo sapiens
tgagaatttgccacccagcttc

SEQ ID NO: 560173 - DNA, 22 bp, Homo sapiens
taaagtgagttagcccaggccc

SEQ ID NO: 560174 - DNA, 22 bp, Homo sapiens
tcagtttagggtgggaggaagg

SEQ ID NO: 560175 - DNA, 22 bp, Homo sapiens
accaggcacaggatctgaactc

SEQ ID NO: 560176 - DNA, 22 bp, Homo sapiens
tttgtttgctcaaacgtgcacc

SEQ ID NO: 560177 - DNA, 22 bp, Homo sapiens
ttgtgtcatattatttgccctt

SEQ ID NO: 560178 - DNA, 22 bp, Homo sapiens
tgttactagaattgtcttagat

SEQ ID NO: 560179 - DNA, 22 bp, Homo sapiens
gagggggaaggtaggggcggcg

SEQ ID NO: 560180 - DNA, 22 bp, Homo sapiens
ttgaggccttcatttctccgtc

SEQ ID NO: 560181 - DNA, 22 bp, Homo sapiens
aaaatccacaatgtctttgagc

SEQ ID NO: 560182 - DNA, 22 bp, Homo sapiens
tggatttctttgtgaatcacca

SEQ ID NO: 560183 - DNA, 22 bp, Homo sapiens
tgatgttctccccacgactgtc

SEQ ID NO: 560184 - DNA, 22 bp, Homo sapiens
gttatttcatccatcttaatga

SEQ ID NO: 560185 - DNA, 22 bp, Homo sapiens
tactgttaatgacctatttctt

SEQ ID NO: 560186 - DNA, 22 bp, Homo sapiens
gaggtagagccaggattcagat

SEQ ID NO: 560187 - DNA, 22 bp, Homo sapiens
cacctactcccagggtcatgca

SEQ ID NO: 560188 - DNA, 22 bp, Homo sapiens
caggtccccagggctcaggctg

SEQ ID NO: 560189 - DNA, 22 bp, Homo sapiens
ccaggactctagacattcagga

SEQ ID NO: 560190 - DNA, 22 bp, Homo sapiens
ccccgggccaatctgtcaaaga

SEQ ID NO: 560191 - DNA, 22 bp, Homo sapiens
ttattttggcattatgccatca

SEQ ID NO: 560192 - DNA, 22 bp, Homo sapiens
ctggagcttcagaggctgcttg

SEQ ID NO: 560193 - DNA, 22 bp, Homo sapiens
agcttccctcactttccacctc

SEQ ID NO: 560194 - DNA, 22 bp, Homo sapiens
ggcccttgcctgcactcctcgg

SEQ ID NO: 560195 - DNA, 22 bp, Homo sapiens
ggtgatggagagagacagcgct

SEQ ID NO: 560196 - DNA, 22 bp, Homo sapiens
tcaagttgcttcagacaatgtt

SEQ ID NO: 560197 - DNA, 22 bp, Homo sapiens
tgagcatccggagaggtgattc

SEQ ID NO: 560198 - DNA, 22 bp, Homo sapiens
caagaggtgtcctaggagcttt

SEQ ID NO: 560199 - DNA, 22 bp, Homo sapiens
tcagcaaagcgtgtctccccac

SEQ ID NO: 560200 - DNA, 22 bp, Homo sapiens
cagaaaggctggcctatatgca

SEQ ID NO: 560201 - DNA, 22 bp, Homo sapiens
tgagagcctatattcattaaag

SEQ ID NO: 560202 - DNA, 22 bp, Homo sapiens
ccaggctgaggtgaaggtgtgc

SEQ ID NO: 560203 - DNA, 22 bp, Homo sapiens
agatggccttaggtgggaattg

SEQ ID NO: 560204 - DNA, 22 bp, Homo sapiens
ctaatatgcgattatgtttagg

SEQ ID NO: 560205 - DNA, 22 bp, Homo sapiens
gattgtgtaagggtacagttgt

SEQ ID NO: 560206 - DNA, 22 bp, Homo sapiens
tgggctgctgggctttctggga

SEQ ID NO: 560207 - DNA, 22 bp, Homo sapiens
tctccccacttttgtattgtta

SEQ ID NO: 560208 - DNA, 22 bp, Homo sapiens
cacccacagggtgaacaggaaa

SEQ ID NO: 560209 - DNA, 22 bp, Homo sapiens
ggaaagcaattcaagcagcaga

SEQ ID NO: 560210 - DNA, 22 bp, Homo sapiens
tccccgaagcagatgtgtgcag

SEQ ID NO: 560211 - DNA, 22 bp, Homo sapiens
tgcccatgacagtcctcatttt

SEQ ID NO: 560212 - DNA, 22 bp, Homo sapiens
tggagggaagagggtctcagac

SEQ ID NO: 560213 - DNA, 22 bp, Homo sapiens
ggggaaccggcccgggcctcgg

SEQ ID NO: 560214 - DNA, 22 bp, Homo sapiens
gcactgagaacaggaagatgaa

SEQ ID NO: 560215 - DNA, 22 bp, Homo sapiens
tgcagggatggaaataagcggg

SEQ ID NO: 560216 - DNA, 22 bp, Homo sapiens
gcactgagttagaatttggggc

SEQ ID NO: 560217 - DNA, 22 bp, Homo sapiens
ggtgtggggaggggagggatag

SEQ ID NO: 560218 - DNA, 22 bp, Homo sapiens
gtgtacaaggctgccaagagag

SEQ ID NO: 560219 - DNA, 22 bp, Homo sapiens
ccatggctgctggccatctgga

SEQ ID NO: 560220 - DNA, 22 bp, Homo sapiens
tttattgtgcactgtctcattt

SEQ ID NO: 560221 - DNA, 22 bp, Homo sapiens
gatactcggatattagatgaat

SEQ ID NO: 560222 - DNA, 22 bp, Homo sapiens
acagacttggcatgcttgctca

SEQ ID NO: 560223 - DNA, 22 bp, Homo sapiens
gagagtttctccctagcatttg

SEQ ID NO: 560224 - DNA, 22 bp, Homo sapiens
aagaagaattggcctactcagg

SEQ ID NO: 560225 - DNA, 22 bp, Homo sapiens
agtgagtggaatgagttgtagg

SEQ ID NO: 560226 - DNA, 22 bp, Homo sapiens
gtttcagcactgaggagttttc

SEQ ID NO: 560227 - DNA, 22 bp, Homo sapiens
aaaggtctcaaaggattcacac

SEQ ID NO: 560228 - DNA, 22 bp, Homo sapiens
cttggaaggtgagtccctgggt

SEQ ID NO: 560229 - DNA, 22 bp, Homo sapiens
ctcgcaggtctctttctcttgc

SEQ ID NO: 560230 - DNA, 22 bp, Homo sapiens
ctcttgctccttcactgggtgg

SEQ ID NO: 560231 - DNA, 22 bp, Homo sapiens
agagcccctgagctgcatgtgg

SEQ ID NO: 560232 - DNA, 22 bp, Homo sapiens
atcctccaggggaaaagctcac

SEQ ID NO: 560233 - DNA, 22 bp, Homo sapiens
taaacaactgacacagccatgg

SEQ ID NO: 560234 - DNA, 22 bp, Homo sapiens
ttccagtttctcttactgatat

SEQ ID NO: 560235 - DNA, 22 bp, Homo sapiens
gcagtgttatttgtagcccaaa

SEQ ID NO: 560236 - DNA, 22 bp, Homo sapiens
ttaaaagcagcattaacaaatg

SEQ ID NO: 560237 - DNA, 22 bp, Homo sapiens
ggagggtggtggccgggggtga

SEQ ID NO: 560238 - DNA, 22 bp, Homo sapiens
agaggttgctccgtgcggtgct

SEQ ID NO: 560239 - DNA, 22 bp, Homo sapiens
aaatcctgctaattgatacact

SEQ ID NO: 560240 - DNA, 22 bp, Homo sapiens
aaacaccacaggggctgataac

SEQ ID NO: 560241 - DNA, 22 bp, Homo sapiens
tcaaaactgaggggcattttct

SEQ ID NO: 560242 - DNA, 22 bp, Homo sapiens
agagaggcaccgccctcagccc

SEQ ID NO: 560243 - DNA, 22 bp, Homo sapiens
tgtgtaaggatgaggcactcca

SEQ ID NO: 560244 - DNA, 22 bp, Homo sapiens
tccccacggccctgggcaggga

SEQ ID NO: 560245 - DNA, 22 bp, Homo sapiens
agtattcagctggaggagctga

SEQ ID NO: 560246 - DNA, 22 bp, Homo sapiens
cagattttctgaggccattagg

SEQ ID NO: 560247 - DNA, 22 bp, Homo sapiens
tcagaagaagctctccttttca

SEQ ID NO: 560248 - DNA, 22 bp, Homo sapiens
tcttcagttttgattcttgagg

SEQ ID NO: 560249 - DNA, 22 bp, Homo sapiens
gttgcacagtctcaggctgggg

SEQ ID NO: 560250 - DNA, 22 bp, Homo sapiens
tgaatgcctgggcttcgctcag

SEQ ID NO: 560251 - DNA, 22 bp, Homo sapiens
ggaccccgcgcgcgcgcgcgca

SEQ ID NO: 560252 - DNA, 22 bp, Homo sapiens
gcttttacagatgattaaatgc

SEQ ID NO: 560253 - DNA, 22 bp, Homo sapiens
tggatgccattgatatgtctca

SEQ ID NO: 560254 - DNA, 22 bp, Homo sapiens
tgtgtgtgcacctgtgtctgtc

SEQ ID NO: 560255 - DNA, 22 bp, Homo sapiens
gatattgcccatctgttttcct

SEQ ID NO: 560256 - DNA, 22 bp, Homo sapiens
gccttccagtttgctcagttgg

SEQ ID NO: 560257 - DNA, 22 bp, Homo sapiens
tggtaggaaagtgtgggaggaa

SEQ ID NO: 560258 - DNA, 22 bp, Homo sapiens
agattgaagcattgcaactcca

SEQ ID NO: 560259 - DNA, 22 bp, Homo sapiens
tggactcacagaggaagctgga

SEQ ID NO: 560260 - DNA, 22 bp, Homo sapiens
cacatttccacttcataaacag

SEQ ID NO: 560261 - DNA, 22 bp, Homo sapiens
gttttaatttgttgaacttgtg

SEQ ID NO: 560262 - DNA, 22 bp, Homo sapiens
taccccattcccttgtgtgctg

SEQ ID NO: 560263 - DNA, 22 bp, Homo sapiens
taaagagaccatggcttctcaa

SEQ ID NO: 560264 - DNA, 22 bp, Homo sapiens
aggggaaatccataagctttgt

SEQ ID NO: 560265 - DNA, 22 bp, Homo sapiens
ttctgtagaatgttctgtgaac

SEQ ID NO: 560266 - DNA, 22 bp, Homo sapiens
cttccagcctgggggctggtga

SEQ ID NO: 560267 - DNA, 22 bp, Homo sapiens
gactacaactcccagtgtgcac

SEQ ID NO: 560268 - DNA, 22 bp, Homo sapiens
cattcctcgaggagccactggt

SEQ ID NO: 560269 - DNA, 22 bp, Homo sapiens
tagaggaaaatccatgttttca

SEQ ID NO: 560270 - DNA, 22 bp, Homo sapiens
agcaaacacctttatgaaattc

SEQ ID NO: 560271 - DNA, 22 bp, Homo sapiens
tctccctgggaatgatgacctt

SEQ ID NO: 560272 - DNA, 22 bp, Homo sapiens
ttatagatagatgccattgtac

SEQ ID NO: 560273 - DNA, 22 bp, Homo sapiens
ttatggtgactctggtgtgtta

SEQ ID NO: 560274 - DNA, 22 bp, Homo sapiens
agggcggggatccctggctttg

SEQ ID NO: 560275 - DNA, 22 bp, Homo sapiens
tgggcagggttctacttaacaa

SEQ ID NO: 560276 - DNA, 22 bp, Homo sapiens
tcagccaccccagtttgcctgg

SEQ ID NO: 560277 - DNA, 22 bp, Homo sapiens
ctatgtaagcacttgtttaatt

SEQ ID NO: 560278 - DNA, 22 bp, Homo sapiens
tctcaatttttatatgtgacag

SEQ ID NO: 560279 - DNA, 22 bp, Homo sapiens
accccccgcgccaggcccaggc

SEQ ID NO: 560280 - DNA, 22 bp, Homo sapiens
gggaagggcaagcagtcttttc

SEQ ID NO: 560281 - DNA, 22 bp, Homo sapiens
ctagagccacccacacctgcac

SEQ ID NO: 560282 - DNA, 22 bp, Homo sapiens
ccctctaatggccatggtgacc

SEQ ID NO: 560283 - DNA, 22 bp, Homo sapiens
ttgctggtggctctgatttcat

SEQ ID NO: 560284 - DNA, 22 bp, Homo sapiens
gagtcccctggtgaggacatgg

SEQ ID NO: 560285 - DNA, 22 bp, Homo sapiens
tgagagagggaaaagcagaatt

SEQ ID NO: 560286 - DNA, 22 bp, Homo sapiens
ttgatgcttaggaaatctgtgg

SEQ ID NO: 560287 - DNA, 22 bp, Homo sapiens
tgcctctgccgctgccccaggg

SEQ ID NO: 560288 - DNA, 22 bp, Homo sapiens
ccgtccattactggagactctg

SEQ ID NO: 560289 - DNA, 22 bp, Homo sapiens
tcgggaaagctgcccgaatgag

SEQ ID NO: 560290 - DNA, 22 bp, Homo sapiens
tcagggcctgagctgggaggtg

SEQ ID NO: 560291 - DNA, 22 bp, Homo sapiens
ttgggggctgtgaccagccaca

SEQ ID NO: 560292 - DNA, 22 bp, Homo sapiens
cattgtaaatgggagtattatc

SEQ ID NO: 560293 - DNA, 22 bp, Homo sapiens
tgaggagagctgtccggctgag

SEQ ID NO: 560294 - DNA, 22 bp, Homo sapiens
tgacctgacagtggcttctggt

SEQ ID NO: 560295 - DNA, 22 bp, Homo sapiens
tccttttcatccttccctgaac

SEQ ID NO: 560296 - DNA, 22 bp, Homo sapiens
ttggtttctcattcctctggtc

SEQ ID NO: 560297 - DNA, 22 bp, Homo sapiens
tggtgagggttggggagcctgg

SEQ ID NO: 560298 - DNA, 22 bp, Homo sapiens
tagggctgctgcctcactcacc

SEQ ID NO: 560299 - DNA, 22 bp, Homo sapiens
tggtgatgacagttggatgcac

SEQ ID NO: 560300 - DNA, 22 bp, Homo sapiens
ttccagctgtctcagtgtcctg

SEQ ID NO: 560301 - DNA, 22 bp, Homo sapiens
ttgacaattcaaaaacaaatgc

SEQ ID NO: 560302 - DNA, 22 bp, Homo sapiens
gaccatccctagccttaaccct

SEQ ID NO: 560303 - DNA, 22 bp, Homo sapiens
tggattcttgccagttttgcat

SEQ ID NO: 560304 - DNA, 22 bp, Homo sapiens
ttgaagcttctcccgcgtgtcg

SEQ ID NO: 560305 - DNA, 22 bp, Homo sapiens
aaagtgcctccttttagagtgt

SEQ ID NO: 560306 - DNA, 22 bp, Homo sapiens
gtgtggggaggttaagggactt

SEQ ID NO: 560307 - DNA, 22 bp, Homo sapiens
acatgtgcacaacatgcaggtt

SEQ ID NO: 560308 - DNA, 22 bp, Homo sapiens
ctaagctaaggggctgtcccat

SEQ ID NO: 560309 - DNA, 22 bp, Homo sapiens
tgtggagatggcagaagccagc

SEQ ID NO: 560310 - DNA, 22 bp, Homo sapiens
tgcctgctgggtaggggcacgt

SEQ ID NO: 560311 - DNA, 22 bp, Homo sapiens
tgcatgagttgctaatatagac

SEQ ID NO: 560312 - DNA, 22 bp, Homo sapiens
tacagggcagggtggggtgaaa

SEQ ID NO: 560313 - DNA, 22 bp, Homo sapiens
gtgtttgtctcctttgtgtcct

SEQ ID NO: 560314 - DNA, 22 bp, Homo sapiens
acagagggctcctctaactatt

SEQ ID NO: 560315 - DNA, 22 bp, Homo sapiens
tgctaacttgactggagaaata

SEQ ID NO: 560316 - DNA, 22 bp, Homo sapiens
tgaaatcaagatgcaagagttg

SEQ ID NO: 560317 - DNA, 22 bp, Homo sapiens
gcgaggtaggtgcttcctgtcc

SEQ ID NO: 560318 - DNA, 22 bp, Homo sapiens
tccattccctttgacgatccct

SEQ ID NO: 560319 - DNA, 22 bp, Homo sapiens
ggaggtacgaggaggcatctgg

SEQ ID NO: 560320 - DNA, 22 bp, Homo sapiens
ttctgctgcttgttgcgtgtct

SEQ ID NO: 560321 - DNA, 22 bp, Homo sapiens
cagtcctggggaaacaccaaaa

SEQ ID NO: 560322 - DNA, 22 bp, Homo sapiens
taggtatatagtgtaaaacctt

SEQ ID NO: 560323 - DNA, 22 bp, Homo sapiens
tcgatgggaaatgatgtgtgat

SEQ ID NO: 560324 - DNA, 22 bp, Homo sapiens
gccttgcctggccctgggcaga

SEQ ID NO: 560325 - DNA, 22 bp, Homo sapiens
gcggccaggacagaggtggagg

SEQ ID NO: 560326 - DNA, 22 bp, Homo sapiens
acagcagaaggtattagtccat

SEQ ID NO: 560327 - DNA, 22 bp, Homo sapiens
agtgtggggggcccaaggctgc

SEQ ID NO: 560328 - DNA, 22 bp, Homo sapiens
ggttttccctgagggaaggtag

SEQ ID NO: 560329 - DNA, 22 bp, Homo sapiens
caggtggtggtgttcccatttt

SEQ ID NO: 560330 - DNA, 22 bp, Homo sapiens
tttccctgattaacagccattt

SEQ ID NO: 560331 - DNA, 22 bp, Homo sapiens
aggtacagtgcttagattttgg

SEQ ID NO: 560332 - DNA, 22 bp, Homo sapiens
gggcccggggccttgcacaact

SEQ ID NO: 560333 - DNA, 22 bp, Homo sapiens
gaggccacaagggtatcattta

SEQ ID NO: 560334 - DNA, 22 bp, Homo sapiens
gggtttctccttctcatttgcc

SEQ ID NO: 560335 - DNA, 22 bp, Homo sapiens
atataaagtcttaaagaaatgg

SEQ ID NO: 560336 - DNA, 22 bp, Homo sapiens
cagcccagagccagttcccgct

SEQ ID NO: 560337 - DNA, 22 bp, Homo sapiens
ttttgcctctaggtgtattgca

SEQ ID NO: 560338 - DNA, 22 bp, Homo sapiens
tcccagtcttcctggggatgtt

SEQ ID NO: 560339 - DNA, 22 bp, Homo sapiens
ctaaatattgtgaacattttct

SEQ ID NO: 560340 - DNA, 22 bp, Homo sapiens
tgtgtctcttgggataatccag

SEQ ID NO: 560341 - DNA, 22 bp, Homo sapiens
ggacgtcattaaagcagtggac

SEQ ID NO: 560342 - DNA, 22 bp, Homo sapiens
acagccatgttttagagaattt

SEQ ID NO: 560343 - DNA, 22 bp, Homo sapiens
ccagcccagctcctacccgccg

SEQ ID NO: 560344 - DNA, 22 bp, Homo sapiens
ctgtcagtatctatagtggatg

SEQ ID NO: 560345 - DNA, 22 bp, Homo sapiens
aggcctctttgcctgcacactc

SEQ ID NO: 560346 - DNA, 22 bp, Homo sapiens
catatacaaagagagaatgcat

SEQ ID NO: 560347 - DNA, 22 bp, Homo sapiens
tggctgtaacctgagaagctgt

SEQ ID NO: 560348 - DNA, 22 bp, Homo sapiens
aggtttctagactcctaggcta

SEQ ID NO: 560349 - DNA, 22 bp, Homo sapiens
gctacacatcatcaaacagcgg

SEQ ID NO: 560350 - DNA, 22 bp, Homo sapiens
cctatttatctcattatataga

SEQ ID NO: 560351 - DNA, 22 bp, Homo sapiens
tgagccgatgctgctccttaat

SEQ ID NO: 560352 - DNA, 22 bp, Homo sapiens
tctgtctgtatccccactgggg

SEQ ID NO: 560353 - DNA, 22 bp, Homo sapiens
cctaagccctaggcttccatca

SEQ ID NO: 560354 - DNA, 22 bp, Homo sapiens
ttcccagttgtttccaaggtct

SEQ ID NO: 560355 - DNA, 22 bp, Homo sapiens
tctgtctaaacctacaagagga

SEQ ID NO: 560356 - DNA, 22 bp, Homo sapiens
cccggcggccgcctcccagagc

SEQ ID NO: 560357 - DNA, 22 bp, Homo sapiens
ttttctgtttttcttttaaaat

SEQ ID NO: 560358 - DNA, 22 bp, Homo sapiens
gcctcgatgccctttagccaaa

SEQ ID NO: 560359 - DNA, 22 bp, Homo sapiens
gcacagagaagccactttcaga

SEQ ID NO: 560360 - DNA, 22 bp, Homo sapiens
atcctccctgggcctctctggc

SEQ ID NO: 560361 - DNA, 22 bp, Homo sapiens
ttctggagggtgggtcagtgca

SEQ ID NO: 560362 - DNA, 22 bp, Homo sapiens
tccttgttttctattttattga

SEQ ID NO: 560363 - DNA, 22 bp, Homo sapiens
tagacagtaaccattttatgaa

SEQ ID NO: 560364 - DNA, 22 bp, Homo sapiens
tctttaatacgagctactattg

SEQ ID NO: 560365 - DNA, 22 bp, Homo sapiens
tccaatgactgcagttggctta

SEQ ID NO: 560366 - DNA, 22 bp, Homo sapiens
ctttatatcattaacataaatg

SEQ ID NO: 560367 - DNA, 22 bp, Homo sapiens
gacgtccagggactcacagagc

SEQ ID NO: 560368 - DNA, 22 bp, Homo sapiens
atgtctcctgggaggagaggcc

SEQ ID NO: 560369 - DNA, 22 bp, Homo sapiens
ctgcctccccatcagttataca

SEQ ID NO: 560370 - DNA, 22 bp, Homo sapiens
tgtgtttgcatgttggagttgg

SEQ ID NO: 560371 - DNA, 22 bp, Homo sapiens
aaccaagccaagctcagcctta

SEQ ID NO: 560372 - DNA, 22 bp, Homo sapiens
ctgcacataatgaggtctgatt

SEQ ID NO: 560373 - DNA, 22 bp, Homo sapiens
ttcctgtgcacattagggatca

SEQ ID NO: 560374 - DNA, 22 bp, Homo sapiens
tctgcccccgcctcctgccagg

SEQ ID NO: 560375 - DNA, 22 bp, Homo sapiens
tcttcctgccatgaaaagaggg

SEQ ID NO: 560376 - DNA, 22 bp, Homo sapiens
tcctaattggtggaaaattggt

SEQ ID NO: 560377 - DNA, 22 bp, Homo sapiens
tcatttctgcttgttctgaaat

SEQ ID NO: 560378 - DNA, 22 bp, Homo sapiens
aggtgatggacagtgtagccat

SEQ ID NO: 560379 - DNA, 22 bp, Homo sapiens
actctgtggcacgggggaagtc

SEQ ID NO: 560380 - DNA, 22 bp, Homo sapiens
ttccagagaagagctctgtttt

SEQ ID NO: 560381 - DNA, 22 bp, Homo sapiens
tgcaaccccttccatctccttg

SEQ ID NO: 560382 - DNA, 22 bp, Homo sapiens
tgcgctcgctcgctgcctgagc

SEQ ID NO: 560383 - DNA, 22 bp, Homo sapiens
tagtttattgaccctgaatgtg

SEQ ID NO: 560384 - DNA, 22 bp, Homo sapiens
ttgagcagctcggagccataag

SEQ ID NO: 560385 - DNA, 22 bp, Homo sapiens
ttccgtgaggtctttggcagtt

SEQ ID NO: 560386 - DNA, 22 bp, Homo sapiens
tattacatacattcaagctcat

SEQ ID NO: 560387 - DNA, 22 bp, Homo sapiens
gcctgctctccagactgctgct

SEQ ID NO: 560388 - DNA, 22 bp, Homo sapiens
gagtcaccatgacagtatagct

SEQ ID NO: 560389 - DNA, 22 bp, Homo sapiens
ctggggatccagctgcacaatt

SEQ ID NO: 560390 - DNA, 22 bp, Homo sapiens
agagcagtggcattctgagcag

SEQ ID NO: 560391 - DNA, 22 bp, Homo sapiens
tctgttcctgaatttggtgtga

SEQ ID NO: 560392 - DNA, 22 bp, Homo sapiens
agaggttggggtggaggtatcc

SEQ ID NO: 560393 - DNA, 22 bp, Homo sapiens
gggatctttttttccttctcca

SEQ ID NO: 560394 - DNA, 22 bp, Homo sapiens
cagctttgccatagcatggact

SEQ ID NO: 560395 - DNA, 22 bp, Homo sapiens
tgcagcacaggggcagttagaa

SEQ ID NO: 560396 - DNA, 22 bp, Homo sapiens
gggaggatggtgcatcacttaa

SEQ ID NO: 560397 - DNA, 22 bp, Homo sapiens
ggccacatcgcctaaccttcga

SEQ ID NO: 560398 - DNA, 22 bp, Homo sapiens
ctgaccactgccagggtaccgg

SEQ ID NO: 560399 - DNA, 22 bp, Homo sapiens
tccatatgtgggtgggctagca

SEQ ID NO: 560400 - DNA, 22 bp, Homo sapiens
ggggacgaacgggacgggtgcg

SEQ ID NO: 560401 - DNA, 22 bp, Homo sapiens
tccaggactggtggtacccttc

SEQ ID NO: 560402 - DNA, 22 bp, Homo sapiens
ggctcacagcagtgcccaacct

SEQ ID NO: 560403 - DNA, 22 bp, Homo sapiens
tgggagctgggacctcacccat

SEQ ID NO: 560404 - DNA, 22 bp, Homo sapiens
tctctgtgagatgccttcctga

SEQ ID NO: 560405 - DNA, 22 bp, Homo sapiens
gtgggtagccctcggtccctgc

SEQ ID NO: 560406 - DNA, 22 bp, Homo sapiens
cccaggtctggggttggctcag

SEQ ID NO: 560407 - DNA, 22 bp, Homo sapiens
tgcaattgttgcttttagttgc

SEQ ID NO: 560408 - DNA, 22 bp, Homo sapiens
tgggaaataagctgatagtaaa

SEQ ID NO: 560409 - DNA, 22 bp, Homo sapiens
cctccccaacgcacacccccgc

SEQ ID NO: 560410 - DNA, 22 bp, Homo sapiens
acggtcacagtctgctttcttt

SEQ ID NO: 560411 - DNA, 22 bp, Homo sapiens
ggtgcggccaagcagggagtca

SEQ ID NO: 560412 - DNA, 22 bp, Homo sapiens
gaatgaagagaggcagagtggg

SEQ ID NO: 560413 - DNA, 22 bp, Homo sapiens
ttatgtactttgatagaaagca

SEQ ID NO: 560414 - DNA, 22 bp, Homo sapiens
cgccgcccagcgcccccacctg

SEQ ID NO: 560415 - DNA, 22 bp, Homo sapiens
cttggcttgggctcagaggcct

SEQ ID NO: 560416 - DNA, 22 bp, Homo sapiens
actgtgttacaccaaaggggaa

SEQ ID NO: 560417 - DNA, 22 bp, Homo sapiens
tagttgcttgaaggcagtgggg

SEQ ID NO: 560418 - DNA, 22 bp, Homo sapiens
ggaagtgggccttcacaatgtc

SEQ ID NO: 560419 - DNA, 22 bp, Homo sapiens
tatgtgcccacttatatgctgc

SEQ ID NO: 560420 - DNA, 22 bp, Homo sapiens
atgaatgatgtaaatgaggcag

SEQ ID NO: 560421 - DNA, 22 bp, Homo sapiens
tgggcctgagcacgggtgctgg

SEQ ID NO: 560422 - DNA, 22 bp, Homo sapiens
tggtataatagcctaatacaca

SEQ ID NO: 560423 - DNA, 22 bp, Homo sapiens
ttctgggtggtgatttagtcaa

SEQ ID NO: 560424 - DNA, 22 bp, Homo sapiens
gagatagcccagggataagggg

SEQ ID NO: 560425 - DNA, 22 bp, Homo sapiens
tttattttcagctgggaaatct

SEQ ID NO: 560426 - DNA, 22 bp, Homo sapiens
taccctgcctcactgcattctc

SEQ ID NO: 560427 - DNA, 22 bp, Homo sapiens
ttgcttctaagcttacttgaaa

SEQ ID NO: 560428 - DNA, 22 bp, Homo sapiens
acaggggagctgatggccagcc

SEQ ID NO: 560429 - DNA, 22 bp, Homo sapiens
tgaaggataacagcattgagtc

SEQ ID NO: 560430 - DNA, 22 bp, Homo sapiens
ttagaattcccttattccattt

SEQ ID NO: 560431 - DNA, 22 bp, Homo sapiens
tggaatttcctgtcaaagcaac

SEQ ID NO: 560432 - DNA, 22 bp, Homo sapiens
gggcactgggtgcctgggctct

SEQ ID NO: 560433 - DNA, 22 bp, Homo sapiens
acactcaggagcatgtctctct

SEQ ID NO: 560434 - DNA, 22 bp, Homo sapiens
tttaggttaattggtgtgatgc

SEQ ID NO: 560435 - DNA, 22 bp, Homo sapiens
ggctgggggaacaatattgctg

SEQ ID NO: 560436 - DNA, 22 bp, Homo sapiens
aacgatttgcagctagagcaaa

SEQ ID NO: 560437 - DNA, 22 bp, Homo sapiens
ggaattaagaggaaggctgtct

SEQ ID NO: 560438 - DNA, 22 bp, Homo sapiens
tatcatcctgctgccttttgtt

SEQ ID NO: 560439 - DNA, 22 bp, Homo sapiens
aaaatgcattccggtgggcacc

SEQ ID NO: 560440 - DNA, 22 bp, Homo sapiens
tgcttcctctcagctcctctcc

SEQ ID NO: 560441 - DNA, 22 bp, Homo sapiens
taaagctgaaggggaagaactg

SEQ ID NO: 560442 - DNA, 22 bp, Homo sapiens
gcgaggagccagctgggggccg

SEQ ID NO: 560443 - DNA, 22 bp, Homo sapiens
tttccagtcctagttgttccac

SEQ ID NO: 560444 - DNA, 22 bp, Homo sapiens
aactgagggaaggcacctgaag

SEQ ID NO: 560445 - DNA, 22 bp, Homo sapiens
gcacccgcatgtcctggtcctt

SEQ ID NO: 560446 - DNA, 22 bp, Homo sapiens
tccatgctgtgcatcttgatga

SEQ ID NO: 560447 - DNA, 22 bp, Homo sapiens
tcagggcaagcttcttagagaa

SEQ ID NO: 560448 - DNA, 22 bp, Homo sapiens
ttaaagatagatggcattgtac

SEQ ID NO: 560449 - DNA, 22 bp, Homo sapiens
agagagagaggaaagtgttgtt

SEQ ID NO: 560450 - DNA, 22 bp, Homo sapiens
ataatacatggttaacctcttt

SEQ ID NO: 560451 - DNA, 22 bp, Homo sapiens
tgtgaatcttctgaaacctttt

SEQ ID NO: 560452 - DNA, 22 bp, Homo sapiens
tggtacctagtagccaggaaga

SEQ ID NO: 560453 - DNA, 22 bp, Homo sapiens
agggttgggtgcttttccttgg

SEQ ID NO: 560454 - DNA, 22 bp, Homo sapiens
cgaggacttttgtgctgcctgt

SEQ ID NO: 560455 - DNA, 22 bp, Homo sapiens
gaagctgggagaagggattgga

SEQ ID NO: 560456 - DNA, 22 bp, Homo sapiens
tggaggttccttaggagggagt

SEQ ID NO: 560457 - DNA, 22 bp, Homo sapiens
tacatggaagcagttctgagaa

SEQ ID NO: 560458 - DNA, 22 bp, Homo sapiens
agcttcagatgagttgttctca

SEQ ID NO: 560459 - DNA, 22 bp, Homo sapiens
tgctccatttccaagcctctcc

SEQ ID NO: 560460 - DNA, 22 bp, Homo sapiens
cagctgtagtttgctggtgctc

SEQ ID NO: 560461 - DNA, 22 bp, Homo sapiens
tgaactgcagcaggcactgggc

SEQ ID NO: 560462 - DNA, 22 bp, Homo sapiens
gtccctgccctgtgccctggga

SEQ ID NO: 560463 - DNA, 22 bp, Homo sapiens
aagatgctggctgggtttggaa

SEQ ID NO: 560464 - DNA, 22 bp, Homo sapiens
tgacattgttgttgctctgctg

SEQ ID NO: 560465 - DNA, 22 bp, Homo sapiens
tatatatgtgtgtgtgtgtata

SEQ ID NO: 560466 - DNA, 22 bp, Homo sapiens
aatggggtggtgcatggagagg

SEQ ID NO: 560467 - DNA, 22 bp, Homo sapiens
tgacctggtgctcaataagtgc

SEQ ID NO: 560468 - DNA, 22 bp, Homo sapiens
taaaataccagatttggaaaac

SEQ ID NO: 560469 - DNA, 22 bp, Homo sapiens
caggcaagttgggaggagatgg

SEQ ID NO: 560470 - DNA, 22 bp, Homo sapiens
gccctgtgactcccatccgctc

SEQ ID NO: 560471 - DNA, 22 bp, Homo sapiens
aaatgctagagaggaaccctgc

SEQ ID NO: 560472 - DNA, 22 bp, Homo sapiens
gaaattggagggaggggcattg

SEQ ID NO: 560473 - DNA, 22 bp, Homo sapiens
taagacgaacaaaaggtttgtc

SEQ ID NO: 560474 - DNA, 22 bp, Homo sapiens
tcagtttcatacattatctgca

SEQ ID NO: 560475 - DNA, 22 bp, Homo sapiens
agggaagtattggtgcggggag

SEQ ID NO: 560476 - DNA, 22 bp, Homo sapiens
actttgaagattttgctctgct

SEQ ID NO: 560477 - DNA, 22 bp, Homo sapiens
tgccctccttgactcctacacc

SEQ ID NO: 560478 - DNA, 22 bp, Homo sapiens
aaagtacataaattctttcaaa

SEQ ID NO: 560479 - DNA, 22 bp, Homo sapiens
atgacaaaacattgaaatctaa

SEQ ID NO: 560480 - DNA, 22 bp, Homo sapiens
gggttgggggttgggtcctctc

SEQ ID NO: 560481 - DNA, 22 bp, Homo sapiens
accctctcccctgccccccaga

SEQ ID NO: 560482 - DNA, 22 bp, Homo sapiens
tctgagaggccactctaactac

SEQ ID NO: 560483 - DNA, 22 bp, Homo sapiens
acaggtgggttcttcagagctg

SEQ ID NO: 560484 - DNA, 22 bp, Homo sapiens
tcaaccagactatttctgttta

SEQ ID NO: 560485 - DNA, 22 bp, Homo sapiens
tataactgggacctcagaatgg

SEQ ID NO: 560486 - DNA, 22 bp, Homo sapiens
aatgctgtcagagctgccttca

SEQ ID NO: 560487 - DNA, 22 bp, Homo sapiens
agtggctgagcttagcctagaa

SEQ ID NO: 560488 - DNA, 22 bp, Homo sapiens
tggggcccatgcccttaagcag

SEQ ID NO: 560489 - DNA, 22 bp, Homo sapiens
atagctgtttcttgagatttgg

SEQ ID NO: 560490 - DNA, 22 bp, Homo sapiens
agctcaggagaggagataggtg

SEQ ID NO: 560491 - DNA, 22 bp, Homo sapiens
gatggaaagtgtgttccgttgg

SEQ ID NO: 560492 - DNA, 22 bp, Homo sapiens
tgaagatacagatttttaacaa

SEQ ID NO: 560493 - DNA, 22 bp, Homo sapiens
tcgccagggggccgggaatgca

SEQ ID NO: 560494 - DNA, 22 bp, Homo sapiens
cacagggcacacaggtgagaaa

SEQ ID NO: 560495 - DNA, 22 bp, Homo sapiens
tgggcattttggggtgggagaa

SEQ ID NO: 560496 - DNA, 22 bp, Homo sapiens
ttcagatgttgggggccatgct

SEQ ID NO: 560497 - DNA, 22 bp, Homo sapiens
ggttgtgtgctggccgctggga

SEQ ID NO: 560498 - DNA, 22 bp, Homo sapiens
tggttctgtggttgttgtctgt

SEQ ID NO: 560499 - DNA, 22 bp, Homo sapiens
ttcctctctcccacctgaagcc

SEQ ID NO: 560500 - DNA, 22 bp, Homo sapiens
taggctgggctggggctgcact

SEQ ID NO: 560501 - DNA, 22 bp, Homo sapiens
tctgcaaatggtggccttcttc

SEQ ID NO: 560502 - DNA, 22 bp, Homo sapiens
agctgtgtgacttcaggcaaag

SEQ ID NO: 560503 - DNA, 22 bp, Homo sapiens
gacatagagggtggtgaggctc

SEQ ID NO: 560504 - DNA, 22 bp, Homo sapiens
tttcagttctggtggttccggt

SEQ ID NO: 560505 - DNA, 22 bp, Homo sapiens
gggtgggttgggaggggttgta

SEQ ID NO: 560506 - DNA, 22 bp, Homo sapiens
tccactctgctccttccgccca

SEQ ID NO: 560507 - DNA, 22 bp, Homo sapiens
taggtttggaagatagagtcct

SEQ ID NO: 560508 - DNA, 22 bp, Homo sapiens
accatacttttcctgggagtac

SEQ ID NO: 560509 - DNA, 22 bp, Homo sapiens
accatagaaggaaaatctacct

SEQ ID NO: 560510 - DNA, 22 bp, Homo sapiens
tgttggccaggctctgggggca

SEQ ID NO: 560511 - DNA, 22 bp, Homo sapiens
tcaggattttttagttctgagt

SEQ ID NO: 560512 - DNA, 22 bp, Homo sapiens
gatggggctccaggcctttgca

SEQ ID NO: 560513 - DNA, 22 bp, Homo sapiens
ctctggccttaatcttttcctg

SEQ ID NO: 560514 - DNA, 22 bp, Homo sapiens
taatgatgctatttactttttg

SEQ ID NO: 560515 - DNA, 22 bp, Homo sapiens
agcttgctcatggagacagcaa

SEQ ID NO: 560516 - DNA, 22 bp, Homo sapiens
ggactatgcttggcacacagta

SEQ ID NO: 560517 - DNA, 22 bp, Homo sapiens
tgctttctggagtctgataaga

SEQ ID NO: 560518 - DNA, 22 bp, Homo sapiens
tgttcatagaagttacagtgtg

SEQ ID NO: 560519 - DNA, 22 bp, Homo sapiens
agagaggaaggaggtctgtaag

SEQ ID NO: 560520 - DNA, 22 bp, Homo sapiens
tatactgtcatggtgactctga

SEQ ID NO: 560521 - DNA, 22 bp, Homo sapiens
cagtggtggggtgggtggggag

SEQ ID NO: 560522 - DNA, 22 bp, Homo sapiens
agcagggcaggctgggacccca

SEQ ID NO: 560523 - DNA, 22 bp, Homo sapiens
tttcaggtatttattcaaagtc

SEQ ID NO: 560524 - DNA, 22 bp, Homo sapiens
tacacacaaattcacaagcttt

SEQ ID NO: 560525 - DNA, 22 bp, Homo sapiens
tggtgctggacccacaggggct

SEQ ID NO: 560526 - DNA, 22 bp, Homo sapiens
tggccaaggctgaggacagcac

SEQ ID NO: 560527 - DNA, 22 bp, Homo sapiens
gggagaatggccagttaatcag

SEQ ID NO: 560528 - DNA, 22 bp, Homo sapiens
tggagggtcatgttcaggatca

SEQ ID NO: 560529 - DNA, 22 bp, Homo sapiens
agattcctgggtcccaccccca

SEQ ID NO: 560530 - DNA, 22 bp, Homo sapiens
gggagacccaccgtcctggact

SEQ ID NO: 560531 - DNA, 22 bp, Homo sapiens
atagcttcaatctattggctag

SEQ ID NO: 560532 - DNA, 22 bp, Homo sapiens
tcaggtgcagtaattgccacag

SEQ ID NO: 560533 - DNA, 22 bp, Homo sapiens
atggccttttgttctccctcat

SEQ ID NO: 560534 - DNA, 22 bp, Homo sapiens
aaattccaagggctacaaacac

SEQ ID NO: 560535 - DNA, 22 bp, Homo sapiens
gcaggaagccagagcaggggag

SEQ ID NO: 560536 - DNA, 22 bp, Homo sapiens
catgcttggctcagtcctgtcc

SEQ ID NO: 560537 - DNA, 22 bp, Homo sapiens
gcctcggcactctcaccttctc

SEQ ID NO: 560538 - DNA, 22 bp, Homo sapiens
caggagataaattgatctgtgc

SEQ ID NO: 560539 - DNA, 22 bp, Homo sapiens
ggcaggcagagcgccatgcttc

SEQ ID NO: 560540 - DNA, 22 bp, Homo sapiens
tccagggagttaggctctgtgg

SEQ ID NO: 560541 - DNA, 22 bp, Homo sapiens
ctctcttgctgctcaatgctaa

SEQ ID NO: 560542 - DNA, 22 bp, Homo sapiens
ggtgtcacccatcactgggccc

SEQ ID NO: 560543 - DNA, 22 bp, Homo sapiens
tgcaatgcttcctcctcttctg

SEQ ID NO: 560544 - DNA, 22 bp, Homo sapiens
caatacttgaccacattttgaa

SEQ ID NO: 560545 - DNA, 22 bp, Homo sapiens
ccacttagctattcagttccat

SEQ ID NO: 560546 - DNA, 22 bp, Homo sapiens
tcctcttttggcaccttcctct

SEQ ID NO: 560547 - DNA, 22 bp, Homo sapiens
atcagttagatagcttgatgtg

SEQ ID NO: 560548 - DNA, 22 bp, Homo sapiens
catcactggcatgatagaccat

SEQ ID NO: 560549 - DNA, 22 bp, Homo sapiens
catgagctttgaagaccctttc

SEQ ID NO: 560550 - DNA, 22 bp, Homo sapiens
agctcgggtgcctcgggtgaga

SEQ ID NO: 560551 - DNA, 22 bp, Homo sapiens
tctcccccgccctcagtccctg

SEQ ID NO: 560552 - DNA, 22 bp, Homo sapiens
aggcggcagcagcagtggggac

SEQ ID NO: 560553 - DNA, 22 bp, Homo sapiens
ctgcaactcatctgtttccttc

SEQ ID NO: 560554 - DNA, 22 bp, Homo sapiens
agctgaaagggcaaaagactga

SEQ ID NO: 560555 - DNA, 22 bp, Homo sapiens
tcaggtctggccatctgtactc

SEQ ID NO: 560556 - DNA, 22 bp, Homo sapiens
tgtgcaattacccattttatgc

SEQ ID NO: 560557 - DNA, 22 bp, Homo sapiens
caggtgttgggaagtgccagga

SEQ ID NO: 560558 - DNA, 22 bp, Homo sapiens
gggcagaggggactggcagcca

SEQ ID NO: 560559 - DNA, 22 bp, Homo sapiens
tgtgtttcttaaagattataga

SEQ ID NO: 560560 - DNA, 22 bp, Homo sapiens
caggctcggggtgctgttctag

SEQ ID NO: 560561 - DNA, 22 bp, Homo sapiens
tctactagtggttgatggcctc

SEQ ID NO: 560562 - DNA, 22 bp, Homo sapiens
ccactttcagcagtctggttta

SEQ ID NO: 560563 - DNA, 22 bp, Homo sapiens
cttcccctccttccccttctcc

SEQ ID NO: 560564 - DNA, 22 bp, Homo sapiens
tgtctttggcatggtctgagct

SEQ ID NO: 560565 - DNA, 22 bp, Homo sapiens
tgtttccagagcaacccttaga

SEQ ID NO: 560566 - DNA, 22 bp, Homo sapiens
gcctccctaagacctttccctc

SEQ ID NO: 560567 - DNA, 22 bp, Homo sapiens
cttgtctacatttctttagaca

SEQ ID NO: 560568 - DNA, 22 bp, Homo sapiens
actgataggcattgctggctga

SEQ ID NO: 560569 - DNA, 22 bp, Homo sapiens
agcagtgacttattgtaagaat

SEQ ID NO: 560570 - DNA, 22 bp, Homo sapiens
tcctaactataaagtggctcct

SEQ ID NO: 560571 - DNA, 22 bp, Homo sapiens
tccttgcagattcatcacttct

SEQ ID NO: 560572 - DNA, 22 bp, Homo sapiens
tgggtcatgataacacctggaa

SEQ ID NO: 560573 - DNA, 22 bp, Homo sapiens
aaatttttagggccattgagca

SEQ ID NO: 560574 - DNA, 22 bp, Homo sapiens
acagtgagaacttttcctgaaa

SEQ ID NO: 560575 - DNA, 22 bp, Homo sapiens
atggattccgggtgttttgggg

SEQ ID NO: 560576 - DNA, 22 bp, Homo sapiens
aggaagacttgtgttggacccc

SEQ ID NO: 560577 - DNA, 22 bp, Homo sapiens
ttctcttcctaacgccagtctg

SEQ ID NO: 560578 - DNA, 22 bp, Homo sapiens
tgcttgctggggttgaggcggt

SEQ ID NO: 560579 - DNA, 22 bp, Homo sapiens
tggcacagagtaagtgctcaat

SEQ ID NO: 560580 - DNA, 22 bp, Homo sapiens
ttactgaggtcgtgtacagacc

SEQ ID NO: 560581 - DNA, 22 bp, Homo sapiens
gctcaagtggtagctgtctcat

SEQ ID NO: 560582 - DNA, 22 bp, Homo sapiens
ttaaggtgaaattgctatgtga

SEQ ID NO: 560583 - DNA, 22 bp, Homo sapiens
gcgtgtggctcccacgtggcct

SEQ ID NO: 560584 - DNA, 22 bp, Homo sapiens
tgagagttggcagcctcagaaa

SEQ ID NO: 560585 - DNA, 22 bp, Homo sapiens
tgaggagctgggagagagaatg

SEQ ID NO: 560586 - DNA, 22 bp, Homo sapiens
aaacagaagggtaggtaaacat

SEQ ID NO: 560587 - DNA, 22 bp, Homo sapiens
atgagtgtagttgtagggagcg

SEQ ID NO: 560588 - DNA, 22 bp, Homo sapiens
actgtgcaggtgatatgggaca

SEQ ID NO: 560589 - DNA, 22 bp, Homo sapiens
gacagggctggcgacaattcat

SEQ ID NO: 560590 - DNA, 22 bp, Homo sapiens
tgggtaggtaggtagttgtgtg

SEQ ID NO: 560591 - DNA, 22 bp, Homo sapiens
tttgccttcccagggatcggcc

SEQ ID NO: 560592 - DNA, 22 bp, Homo sapiens
tcattgcccggaagggaattct

SEQ ID NO: 560593 - DNA, 22 bp, Homo sapiens
aaaagaagcacggctccgggga

SEQ ID NO: 560594 - DNA, 22 bp, Homo sapiens
gcggttaagactctaacaaacg

SEQ ID NO: 560595 - DNA, 22 bp, Homo sapiens
gcgcggcgccggccagcccgcc

SEQ ID NO: 560596 - DNA, 22 bp, Homo sapiens
caaactcctactttctcattct

SEQ ID NO: 560597 - DNA, 22 bp, Homo sapiens
cactctagctgtctgggctgca

SEQ ID NO: 560598 - DNA, 22 bp, Homo sapiens
aggttctacaattctaccaggt

SEQ ID NO: 560599 - DNA, 22 bp, Homo sapiens
ctatgcgctaatacgggtcccc

SEQ ID NO: 560600 - DNA, 22 bp, Homo sapiens
tgtcattagctgtttaagcgta

SEQ ID NO: 560601 - DNA, 22 bp, Homo sapiens
tctctttaccgcgaggaaagct

SEQ ID NO: 560602 - DNA, 22 bp, Homo sapiens
tcttgtttgtgatatcgcaatc

SEQ ID NO: 560603 - DNA, 22 bp, Homo sapiens
gagggagctgggagagtttgga

SEQ ID NO: 560604 - DNA, 22 bp, Homo sapiens
cacgtgatgatctggctaggat

SEQ ID NO: 560605 - DNA, 22 bp, Homo sapiens
ttatacctaaaattgagggctg

SEQ ID NO: 560606 - DNA, 22 bp, Homo sapiens
tacgttgtgtgtatctgaagtt

SEQ ID NO: 560607 - DNA, 22 bp, Homo sapiens
ttagaagaggtaaatttccttt

SEQ ID NO: 560608 - DNA, 22 bp, Homo sapiens
acatttgcagtgtcaaccgcct

SEQ ID NO: 560609 - DNA, 22 bp, Homo sapiens
tggctggggcagagatggggga

SEQ ID NO: 560610 - DNA, 22 bp, Homo sapiens
ttcaaaagcggtccaggaagat

SEQ ID NO: 560611 - DNA, 22 bp, Homo sapiens
tgctcagcctgagcagccgggt

SEQ ID NO: 560612 - DNA, 22 bp, Homo sapiens
tacagctactcacaaaaagtat

SEQ ID NO: 560613 - DNA, 22 bp, Homo sapiens
tctgattattgacagggagctt

SEQ ID NO: 560614 - DNA, 22 bp, Homo sapiens
ttatgagcccactggtgaatcc

SEQ ID NO: 560615 - DNA, 22 bp, Homo sapiens
tgttcttggttttggagataca

SEQ ID NO: 560616 - DNA, 22 bp, Homo sapiens
taggctggaggcaaagaggcag

SEQ ID NO: 560617 - DNA, 22 bp, Homo sapiens
tgaatgtatttccaagaaagca

SEQ ID NO: 560618 - DNA, 22 bp, Homo sapiens
tcctgaggagtcccaatgtgct

SEQ ID NO: 560619 - DNA, 22 bp, Homo sapiens
tacttgtcagcttcttggatga

SEQ ID NO: 560620 - DNA, 22 bp, Homo sapiens
tccgtgattggctcagccactt

SEQ ID NO: 560621 - DNA, 22 bp, Homo sapiens
tcgcacaatccgattccttggg

SEQ ID NO: 560622 - DNA, 22 bp, Homo sapiens
ctgctctataggaaacccattg

SEQ ID NO: 560623 - DNA, 22 bp, Homo sapiens
agactttccaggtcctgggcta

SEQ ID NO: 560624 - DNA, 22 bp, Homo sapiens
tagtttcagactgatttcacaa

SEQ ID NO: 560625 - DNA, 22 bp, Homo sapiens
cagctgatggggagggtgtcct

SEQ ID NO: 560626 - DNA, 22 bp, Homo sapiens
gcctgtggttcattgattctga

SEQ ID NO: 560627 - DNA, 22 bp, Homo sapiens
tctcccgtttcctgtgtatggt

SEQ ID NO: 560628 - DNA, 22 bp, Homo sapiens
tccaagtgcgagtagtaggccg

SEQ ID NO: 560629 - DNA, 22 bp, Homo sapiens
gggactgggggatggtgggaag

SEQ ID NO: 560630 - DNA, 22 bp, Homo sapiens
cagccctgtaggagttaggggg

SEQ ID NO: 560631 - DNA, 22 bp, Homo sapiens
ataataatgaaggagctcactg

SEQ ID NO: 560632 - DNA, 22 bp, Homo sapiens
atagaggtgacaggttaggata

SEQ ID NO: 560633 - DNA, 22 bp, Homo sapiens
tccattgtttttagtccattcc

SEQ ID NO: 560634 - DNA, 22 bp, Homo sapiens
gaggtctcggaactgctgattg

SEQ ID NO: 560635 - DNA, 22 bp, Homo sapiens
agggaagacttcgttagagagt

SEQ ID NO: 560636 - DNA, 22 bp, Homo sapiens
tatgtcagttgatccacagtcc

SEQ ID NO: 560637 - DNA, 22 bp, Homo sapiens
tggctgagaagttctggtggga

SEQ ID NO: 560638 - DNA, 22 bp, Homo sapiens
ggtctggccgggtcccccctct

SEQ ID NO: 560639 - DNA, 22 bp, Homo sapiens
agtgggagggcgatggcgcccc

SEQ ID NO: 560640 - DNA, 22 bp, Homo sapiens
tcatgattggaaatggttggcc

SEQ ID NO: 560641 - DNA, 22 bp, Homo sapiens
tgtgtgtatttagattactcat

SEQ ID NO: 560642 - DNA, 22 bp, Homo sapiens
ccatattttttaaagtgttgtc

SEQ ID NO: 560643 - DNA, 22 bp, Homo sapiens
ctgggcttcagaggttgttgct

SEQ ID NO: 560644 - DNA, 22 bp, Homo sapiens
agtctatcttattgtcctttag

SEQ ID NO: 560645 - DNA, 22 bp, Homo sapiens
aatgcctctcacagagaacagg

SEQ ID NO: 560646 - DNA, 22 bp, Homo sapiens
tacttgttatagaatttcaggt

SEQ ID NO: 560647 - DNA, 22 bp, Homo sapiens
tgtagcaggttctgttgctgct

SEQ ID NO: 560648 - DNA, 22 bp, Homo sapiens
tagatttgcatgcttataacat

SEQ ID NO: 560649 - DNA, 22 bp, Homo sapiens
tttgagtaagtatagatggttt

SEQ ID NO: 560650 - DNA, 22 bp, Homo sapiens
tgcgagggggaggaggtgcggc

SEQ ID NO: 560651 - DNA, 22 bp, Homo sapiens
ccgcgacccctctgggacccgc

SEQ ID NO: 560652 - DNA, 22 bp, Homo sapiens
tccctctcagaaatccaggttt

SEQ ID NO: 560653 - DNA, 22 bp, Homo sapiens
tcatattaccattagctcatct

SEQ ID NO: 560654 - DNA, 22 bp, Homo sapiens
ctgcaatgtcattcccagaagt

SEQ ID NO: 560655 - DNA, 22 bp, Homo sapiens
aggccatgtacttggaaagcgg

SEQ ID NO: 560656 - DNA, 22 bp, Homo sapiens
gcgcgcttagactcttgggagt

SEQ ID NO: 560657 - DNA, 22 bp, Homo sapiens
tgtgcgggaggctgagtccagc

SEQ ID NO: 560658 - DNA, 22 bp, Homo sapiens
tctgcattttgtagaacccatg

SEQ ID NO: 560659 - DNA, 22 bp, Homo sapiens
gtctttgggatgtgcctatggt

SEQ ID NO: 560660 - DNA, 22 bp, Homo sapiens
ttaatgtaccttattattccat

SEQ ID NO: 560661 - DNA, 22 bp, Homo sapiens
aggtttttgctggaaggtaatt

SEQ ID NO: 560662 - DNA, 22 bp, Homo sapiens
tcaggcagacacaggactcacg

SEQ ID NO: 560663 - DNA, 22 bp, Homo sapiens
tctctctgctggtcttttcccc

SEQ ID NO: 560664 - DNA, 22 bp, Homo sapiens
ggggccctggtagaagctgcct

SEQ ID NO: 560665 - DNA, 22 bp, Homo sapiens
tccaatgtgttaatgagcaatg

SEQ ID NO: 560666 - DNA, 22 bp, Homo sapiens
ttcagtctcagtattattgaca

SEQ ID NO: 560667 - DNA, 22 bp, Homo sapiens
tttggtggggggtgcactgatc

SEQ ID NO: 560668 - DNA, 22 bp, Homo sapiens
gcagacagttatccctttctag

SEQ ID NO: 560669 - DNA, 22 bp, Homo sapiens
tgggagatgagggtgggaggaa

SEQ ID NO: 560670 - DNA, 22 bp, Homo sapiens
gatgaggccgctgaagggcacc

SEQ ID NO: 560671 - DNA, 22 bp, Homo sapiens
ttgacgatcatgtacttttatg

SEQ ID NO: 560672 - DNA, 22 bp, Homo sapiens
gcttgtggcagcaggtgtatgt

SEQ ID NO: 560673 - DNA, 22 bp, Homo sapiens
ggtagattttccttctatggtt

SEQ ID NO: 560674 - DNA, 22 bp, Homo sapiens
ggggccaaagagggaggagatc

SEQ ID NO: 560675 - DNA, 22 bp, Homo sapiens
tggagtgccttttccttctatt

SEQ ID NO: 560676 - DNA, 22 bp, Homo sapiens
tctttgcttgccagctcctgaa

SEQ ID NO: 560677 - DNA, 22 bp, Homo sapiens
catgtatatcattaactagtgc

SEQ ID NO: 560678 - DNA, 22 bp, Homo sapiens
cctggctcggggactcctgccc

SEQ ID NO: 560679 - DNA, 22 bp, Homo sapiens
tttaaatggccactctggcttc

SEQ ID NO: 560680 - DNA, 22 bp, Homo sapiens
tgtgagggtacagggggaaggt

SEQ ID NO: 560681 - DNA, 22 bp, Homo sapiens
cattagattaattcagggaatg

SEQ ID NO: 560682 - DNA, 22 bp, Homo sapiens
agcactcgacaaatgttagcca

SEQ ID NO: 560683 - DNA, 22 bp, Homo sapiens
tcctcctccccgctgggacagc

SEQ ID NO: 560684 - DNA, 22 bp, Homo sapiens
tcatctcaggtacagattttag

SEQ ID NO: 560685 - DNA, 22 bp, Homo sapiens
ttccaagtcaaagaatcccaaa

SEQ ID NO: 560686 - DNA, 22 bp, Homo sapiens
ttaatatgtattgagtacttta

SEQ ID NO: 560687 - DNA, 22 bp, Homo sapiens
gaagatgaaagttgcttttctg

SEQ ID NO: 560688 - DNA, 22 bp, Homo sapiens
actcgagccccagggtctgatg

SEQ ID NO: 560689 - DNA, 22 bp, Homo sapiens
acatgaatagagcagcctggtg

SEQ ID NO: 560690 - DNA, 22 bp, Homo sapiens
tgagtgcttgatagatagaggt

SEQ ID NO: 560691 - DNA, 22 bp, Homo sapiens
ggtgtgggtcaagcaaccaggt

SEQ ID NO: 560692 - DNA, 22 bp, Homo sapiens
tttggtatggtcaaagcctgtg

SEQ ID NO: 560693 - DNA, 22 bp, Homo sapiens
ttttctgtcagctgcctgacag

SEQ ID NO: 560694 - DNA, 22 bp, Homo sapiens
cagttcagaagtgttcctgagt

SEQ ID NO: 560695 - DNA, 22 bp, Homo sapiens
ataaatcttgttattgactaga

SEQ ID NO: 560696 - DNA, 22 bp, Homo sapiens
atggatggaaaccttcaagcag

SEQ ID NO: 560697 - DNA, 22 bp, Homo sapiens
aaattttcagggctactgaaca

SEQ ID NO: 560698 - DNA, 22 bp, Homo sapiens
tgatgagggtagagttagattt

SEQ ID NO: 560699 - DNA, 22 bp, Homo sapiens
tcttcctggggcctcagaggtg

SEQ ID NO: 560700 - DNA, 22 bp, Homo sapiens
tcgtaatgaagcggcttcttaa

SEQ ID NO: 560701 - DNA, 22 bp, Homo sapiens
ttgcttttctctagttggtaat

SEQ ID NO: 560702 - DNA, 22 bp, Homo sapiens
cctcccctcccagccccacccc

SEQ ID NO: 560703 - DNA, 22 bp, Homo sapiens
tccatttacttgcttcttctga

SEQ ID NO: 560704 - DNA, 22 bp, Homo sapiens
tgaaaagtgtctgctgcatttc

SEQ ID NO: 560705 - DNA, 22 bp, Homo sapiens
aaataggtactattcccatttt

SEQ ID NO: 560706 - DNA, 22 bp, Homo sapiens
tcttggctgtggggcctcagct

SEQ ID NO: 560707 - DNA, 22 bp, Homo sapiens
tatccacaggggtctgtgctct

SEQ ID NO: 560708 - DNA, 22 bp, Homo sapiens
ttgaccttaataatctgctcca

SEQ ID NO: 560709 - DNA, 22 bp, Homo sapiens
tgtggcatctcagggagctaga

SEQ ID NO: 560710 - DNA, 22 bp, Homo sapiens
gtctgttttcttgtgttagttt

SEQ ID NO: 560711 - DNA, 22 bp, Homo sapiens
gctccaggcagccaggtcttcc

SEQ ID NO: 560712 - DNA, 22 bp, Homo sapiens
ggagagagagtgaggagagctg

SEQ ID NO: 560713 - DNA, 22 bp, Homo sapiens
cagggaaagaccagagacagcc

SEQ ID NO: 560714 - DNA, 22 bp, Homo sapiens
ggctgggagggaggtcagaatg

SEQ ID NO: 560715 - DNA, 22 bp, Homo sapiens
agggcatgggaaggacccaagg

SEQ ID NO: 560716 - DNA, 22 bp, Homo sapiens
acagctgcatgaaaacaacttt

SEQ ID NO: 560717 - DNA, 22 bp, Homo sapiens
gttttttttcaacttgttacag

SEQ ID NO: 560718 - DNA, 22 bp, Homo sapiens
aaggaagggtcttaggggatcc

SEQ ID NO: 560719 - DNA, 22 bp, Homo sapiens
tgacctgttgggctaatggcct

SEQ ID NO: 560720 - DNA, 22 bp, Homo sapiens
ttcagcttttagaaggaatcgg

SEQ ID NO: 560721 - DNA, 22 bp, Homo sapiens
ttcaacttttagaaggaatcag

SEQ ID NO: 560722 - DNA, 22 bp, Homo sapiens
cacctcagccatgtggaggcag

SEQ ID NO: 560723 - DNA, 22 bp, Homo sapiens
catgaatagagcagcctcgtgc

SEQ ID NO: 560724 - DNA, 22 bp, Homo sapiens
tggtcagtagagtgctcctcaa

SEQ ID NO: 560725 - DNA, 22 bp, Homo sapiens
attgctccacaagtgaggatgg

SEQ ID NO: 560726 - DNA, 22 bp, Homo sapiens
tacaaaatgattactgtttact

SEQ ID NO: 560727 - DNA, 22 bp, Homo sapiens
tggagagggctgatagggagtg

SEQ ID NO: 560728 - DNA, 22 bp, Homo sapiens
attcttgtgacttttgtaacat

SEQ ID NO: 560729 - DNA, 22 bp, Homo sapiens
ggcaggactggacacggagaca

SEQ ID NO: 560730 - DNA, 22 bp, Homo sapiens
tacagcctgtgtcctgctctgt

SEQ ID NO: 560731 - DNA, 22 bp, Homo sapiens
tactgactttgcaataaagaag

SEQ ID NO: 560732 - DNA, 22 bp, Homo sapiens
tggtccagcccaacccttgtct

SEQ ID NO: 560733 - DNA, 22 bp, Homo sapiens
tcattcttgcatctctggggtc

SEQ ID NO: 560734 - DNA, 22 bp, Homo sapiens
aaagtgcatctttttagaggat

SEQ ID NO: 560735 - DNA, 22 bp, Homo sapiens
tgggaccttccggtttctcctg

SEQ ID NO: 560736 - DNA, 22 bp, Homo sapiens
cagcctactcatttatttttgg

SEQ ID NO: 560737 - DNA, 22 bp, Homo sapiens
agcctagcttgggtttactggt

SEQ ID NO: 560738 - DNA, 22 bp, Homo sapiens
gaatgggcctggatggctcccc

SEQ ID NO: 560739 - DNA, 22 bp, Homo sapiens
gatcgggtgcaagcacagaggc

SEQ ID NO: 560740 - DNA, 22 bp, Homo sapiens
atggcaggcctaactgaggttg

SEQ ID NO: 560741 - DNA, 22 bp, Homo sapiens
ttggtaactctggagcaagggc

SEQ ID NO: 560742 - DNA, 22 bp, Homo sapiens
cagaaagccacagtgcattgct

SEQ ID NO: 560743 - DNA, 22 bp, Homo sapiens
atctccatcacccggctcccct

SEQ ID NO: 560744 - DNA, 22 bp, Homo sapiens
ttcaatcactaagtaaatttac

SEQ ID NO: 560745 - DNA, 22 bp, Homo sapiens
cattgtcagtaaaagttgtaat

SEQ ID NO: 560746 - DNA, 22 bp, Homo sapiens
tactgctgtggtaatgatgcag

SEQ ID NO: 560747 - DNA, 22 bp, Homo sapiens
taaaccctaaggactacatcag

SEQ ID NO: 560748 - DNA, 22 bp, Homo sapiens
tgagtgataatagggtcgtgac

SEQ ID NO: 560749 - DNA, 22 bp, Homo sapiens
tgagcccccgcgcccgggcagc

SEQ ID NO: 560750 - DNA, 22 bp, Homo sapiens
tataacttgcactgtaggaatg

SEQ ID NO: 560751 - DNA, 22 bp, Homo sapiens
gatgagtgatgggtctttctga

SEQ ID NO: 560752 - DNA, 22 bp, Homo sapiens
gggcctaacccaggggtctgca

SEQ ID NO: 560753 - DNA, 22 bp, Homo sapiens
gaggcaggtgcgagatgagccc

SEQ ID NO: 560754 - DNA, 22 bp, Homo sapiens
tcggctcatagaatatttgtaa

SEQ ID NO: 560755 - DNA, 22 bp, Homo sapiens
ttactgaatgtattgcttggac

SEQ ID NO: 560756 - DNA, 22 bp, Homo sapiens
tatttgctaatatgcaaatttt

SEQ ID NO: 560757 - DNA, 22 bp, Homo sapiens
cagaagccgactgcccctctgg

SEQ ID NO: 560758 - DNA, 22 bp, Homo sapiens
tacagcagttctgtgtatacat

SEQ ID NO: 560759 - DNA, 22 bp, Homo sapiens
cgcggggtggctggggctacgt

SEQ ID NO: 560760 - DNA, 22 bp, Homo sapiens
gaagaggagagattgagctgtg

SEQ ID NO: 560761 - DNA, 22 bp, Homo sapiens
tcacttttatagacaggtctgg

SEQ ID NO: 560762 - DNA, 22 bp, Homo sapiens
tatggtaggggttttgagctgt

SEQ ID NO: 560763 - DNA, 22 bp, Homo sapiens
tgcttcgtgccctcccactctg

SEQ ID NO: 560764 - DNA, 22 bp, Homo sapiens
agcaattttatttcctcttctc

SEQ ID NO: 560765 - DNA, 22 bp, Homo sapiens
actcagatgctgatggtccttc

SEQ ID NO: 560766 - DNA, 22 bp, Homo sapiens
gagagctttgggtggactgaga

SEQ ID NO: 560767 - DNA, 22 bp, Homo sapiens
acagaggcacagatgataggca

SEQ ID NO: 560768 - DNA, 22 bp, Homo sapiens
gacagctcttttaaaagcaggc

SEQ ID NO: 560769 - DNA, 22 bp, Homo sapiens
gaacagtaggccctctgaaggg

SEQ ID NO: 560770 - DNA, 22 bp, Homo sapiens
tcagagatttcaaagggaggca

SEQ ID NO: 560771 - DNA, 22 bp, Homo sapiens
gcagcctgggacatctggaggg

SEQ ID NO: 560772 - DNA, 22 bp, Homo sapiens
gagtcggggacttgcacctgca

SEQ ID NO: 560773 - DNA, 22 bp, Homo sapiens
aactaaactgtgggctcttctc

SEQ ID NO: 560774 - DNA, 22 bp, Homo sapiens
agtcatgttttattgtaaatgt

SEQ ID NO: 560775 - DNA, 22 bp, Homo sapiens
cctgagatatgctgatggcctg

SEQ ID NO: 560776 - DNA, 22 bp, Homo sapiens
ctttttggcttcttattcactc

SEQ ID NO: 560777 - DNA, 22 bp, Homo sapiens
attcttgtctccatgctctagg

SEQ ID NO: 560778 - DNA, 22 bp, Homo sapiens
tctgaagccatggttgttggaa

SEQ ID NO: 560779 - DNA, 22 bp, Homo sapiens
taggatctttccgtctgactta

SEQ ID NO: 560780 - DNA, 22 bp, Homo sapiens
gcagtagttaaggagaggagag

SEQ ID NO: 560781 - DNA, 22 bp, Homo sapiens
tgttgacattggggacattatc

SEQ ID NO: 560782 - DNA, 22 bp, Homo sapiens
agtggattaaaaacaatggagg

SEQ ID NO: 560783 - DNA, 22 bp, Homo sapiens
aggctgtgcctacgtgcctttt

SEQ ID NO: 560784 - DNA, 22 bp, Homo sapiens
ggtagctttttctgtgtgtttt

SEQ ID NO: 560785 - DNA, 22 bp, Homo sapiens
tggttagaacatgctcaagagc

SEQ ID NO: 560786 - DNA, 22 bp, Homo sapiens
atatgtgttggttgaacgaacc

SEQ ID NO: 560787 - DNA, 22 bp, Homo sapiens
cgaggccggcgtgggggtgggg

SEQ ID NO: 560788 - DNA, 22 bp, Homo sapiens
cgggctgggaggcggaggctga

SEQ ID NO: 560789 - DNA, 22 bp, Homo sapiens
tgtatgccctcaccgctcagcc

SEQ ID NO: 560790 - DNA, 22 bp, Homo sapiens
ttcggtgttagaagatgaaatt

SEQ ID NO: 560791 - DNA, 22 bp, Homo sapiens
agggaggtggtttaggcagaag

SEQ ID NO: 560792 - DNA, 22 bp, Homo sapiens
tgtggctcactcctgggttccc

SEQ ID NO: 560793 - DNA, 22 bp, Homo sapiens
cattgcatgctaggacctgtag

SEQ ID NO: 560794 - DNA, 22 bp, Homo sapiens
ggctgccctgcctgcctccagg

SEQ ID NO: 560795 - DNA, 22 bp, Homo sapiens
tatgtcagttataaaagacaga

SEQ ID NO: 560796 - DNA, 22 bp, Homo sapiens
tgcactccttgcagcattctgg

SEQ ID NO: 560797 - DNA, 22 bp, Homo sapiens
ttctcccatctttattcgctag

SEQ ID NO: 560798 - DNA, 22 bp, Homo sapiens
tgggcagagttctacttaacac

SEQ ID NO: 560799 - DNA, 22 bp, Homo sapiens
aaggccaggccagatgacagtc

SEQ ID NO: 560800 - DNA, 22 bp, Homo sapiens
tggggaatatgcatgaaaacat

SEQ ID NO: 560801 - DNA, 22 bp, Homo sapiens
gtcctgggatttgcccttttct

SEQ ID NO: 560802 - DNA, 22 bp, Homo sapiens
ttttttgctcctgtctccagac

SEQ ID NO: 560803 - DNA, 22 bp, Homo sapiens
actcacattcctagagaaaaga

SEQ ID NO: 560804 - DNA, 22 bp, Homo sapiens
tctagagtagtgaagaagaact

SEQ ID NO: 560805 - DNA, 22 bp, Homo sapiens
caccctggcctgtggagccagg

SEQ ID NO: 560806 - DNA, 22 bp, Homo sapiens
ggcaaagggagatcttaatcag

SEQ ID NO: 560807 - DNA, 22 bp, Homo sapiens
tcagcatgcatatcattaacta

SEQ ID NO: 560808 - DNA, 22 bp, Homo sapiens
taatatgtctaatgattgctaa

SEQ ID NO: 560809 - DNA, 22 bp, Homo sapiens
tcagcactcaataaaagcttaa

SEQ ID NO: 560810 - DNA, 22 bp, Homo sapiens
ggtcaatagaatcattgtaggt

SEQ ID NO: 560811 - DNA, 22 bp, Homo sapiens
tccctcctccttcccactgtgc

SEQ ID NO: 560812 - DNA, 22 bp, Homo sapiens
tggggtcaggtgtgtgcacagg

SEQ ID NO: 560813 - DNA, 22 bp, Homo sapiens
ggaggaggccatagtggcaact

SEQ ID NO: 560814 - DNA, 22 bp, Homo sapiens
tggtcggctgttccctctccca

SEQ ID NO: 560815 - DNA, 22 bp, Homo sapiens
ggggcttgactcctccctgaga

SEQ ID NO: 560816 - DNA, 22 bp, Homo sapiens
ttttggttcctctgtctttaaa

SEQ ID NO: 560817 - DNA, 22 bp, Homo sapiens
tcttttcaaaataattaaaacc

SEQ ID NO: 560818 - DNA, 22 bp, Homo sapiens
gtgccctgggccttccaggaca

SEQ ID NO: 560819 - DNA, 22 bp, Homo sapiens
gctggccactcttgggaaagct

SEQ ID NO: 560820 - DNA, 22 bp, Homo sapiens
cagctccctgaggaaaggaggg

SEQ ID NO: 560821 - DNA, 22 bp, Homo sapiens
tgtttgcactggctgtttaaac

SEQ ID NO: 560822 - DNA, 22 bp, Homo sapiens
tgggtgtggcaaagccaaagaa

SEQ ID NO: 560823 - DNA, 22 bp, Homo sapiens
tatcatgtgattgtgattaaaa

SEQ ID NO: 560824 - DNA, 22 bp, Homo sapiens
acggttcactcaagtaaagcag

SEQ ID NO: 560825 - DNA, 22 bp, Homo sapiens
cacatgcatgcttgaatatctg

SEQ ID NO: 560826 - DNA, 22 bp, Homo sapiens
ggataaggtaggagttgggggt

SEQ ID NO: 560827 - DNA, 22 bp, Homo sapiens
tctgtgatcaagttctctgcct

SEQ ID NO: 560828 - DNA, 22 bp, Homo sapiens
tgctatgcatgtcatatgtgag

SEQ ID NO: 560829 - DNA, 22 bp, Homo sapiens
ttatttcaatgataccaccaaa

SEQ ID NO: 560830 - DNA, 22 bp, Homo sapiens
acaagtcttatttgagcacctg

SEQ ID NO: 560831 - DNA, 22 bp, Homo sapiens
catattcagctcttggatgtga

SEQ ID NO: 560832 - DNA, 22 bp, Homo sapiens
ccctccctgaattcctagagaa

SEQ ID NO: 560833 - DNA, 22 bp, Homo sapiens
tctggcacacctactcactttg

SEQ ID NO: 560834 - DNA, 22 bp, Homo sapiens
aacagcaaccttccctaaagtg

SEQ ID NO: 560835 - DNA, 22 bp, Homo sapiens
gattgacaaggaagcattggaa

SEQ ID NO: 560836 - DNA, 22 bp, Homo sapiens
tggcggggcagggtgtgggcac

SEQ ID NO: 560837 - DNA, 22 bp, Homo sapiens
cttggcactgggccgatgggcg

SEQ ID NO: 560838 - DNA, 22 bp, Homo sapiens
aaataaccttgtaattaaactg

SEQ ID NO: 560839 - DNA, 22 bp, Homo sapiens
cttgggtgagtcaccctcctct

SEQ ID NO: 560840 - DNA, 22 bp, Homo sapiens
gggagtaaggttcttgtcagtt

SEQ ID NO: 560841 - DNA, 22 bp, Homo sapiens
tgctgccgaggcttctagcagg

SEQ ID NO: 560842 - DNA, 22 bp, Homo sapiens
tgagatactattggggagcatg

SEQ ID NO: 560843 - DNA, 22 bp, Homo sapiens
ttgcctcccaagagggaaaata

SEQ ID NO: 560844 - DNA, 22 bp, Homo sapiens
ggtgcaaggatgagtaggctgt

SEQ ID NO: 560845 - DNA, 22 bp, Homo sapiens
cagagaaagagagagagtatac

SEQ ID NO: 560846 - DNA, 22 bp, Homo sapiens
ataagatgagaatagagatgat

SEQ ID NO: 560847 - DNA, 22 bp, Homo sapiens
tgggtggagaggacaggatggg

SEQ ID NO: 560848 - DNA, 22 bp, Homo sapiens
aggagggaagttgggtagggtg

SEQ ID NO: 560849 - DNA, 22 bp, Homo sapiens
tgtggattagactggcagcaaa

SEQ ID NO: 560850 - DNA, 22 bp, Homo sapiens
tttatgagacctctccccataa

SEQ ID NO: 560851 - DNA, 22 bp, Homo sapiens
tccctgtcccccgtggaggctc

SEQ ID NO: 560852 - DNA, 22 bp, Homo sapiens
aagggtaaagtgatgtgctagt

SEQ ID NO: 560853 - DNA, 22 bp, Homo sapiens
aagtaggggtggagggcgaaga

SEQ ID NO: 560854 - DNA, 22 bp, Homo sapiens
tctggctcgctaggctctgggg

SEQ ID NO: 560855 - DNA, 22 bp, Homo sapiens
tgtgtgaccctatgggaaaatt

SEQ ID NO: 560856 - DNA, 22 bp, Homo sapiens
ttgccaaggactggccagtggg

SEQ ID NO: 560857 - DNA, 22 bp, Homo sapiens
ctccagcccgggggcaggtgac

SEQ ID NO: 560858 - DNA, 22 bp, Homo sapiens
cttactcattttctctgggggt

SEQ ID NO: 560859 - DNA, 22 bp, Homo sapiens
ctaaatgtcaaacatattctta

SEQ ID NO: 560860 - DNA, 22 bp, Homo sapiens
tgctctgacgaggttgcactac

SEQ ID NO: 560861 - DNA, 22 bp, Homo sapiens
gtttcagtcccttagtttgcag

SEQ ID NO: 560862 - DNA, 22 bp, Homo sapiens
tgtttgtctatatagaagtggt

SEQ ID NO: 560863 - DNA, 22 bp, Homo sapiens
tgcttgttcttggaaatttcct

SEQ ID NO: 560864 - DNA, 22 bp, Homo sapiens
gataaattttgtggcactttta

SEQ ID NO: 560865 - DNA, 22 bp, Homo sapiens
tattgtgggcccacctctgcct

SEQ ID NO: 560866 - DNA, 22 bp, Homo sapiens
cgggtgggcctctgcgctgctg

SEQ ID NO: 560867 - DNA, 22 bp, Homo sapiens
ttccaagtatgacattttagag

SEQ ID NO: 560868 - DNA, 22 bp, Homo sapiens
gcctggcgccctctttccccac

SEQ ID NO: 560869 - DNA, 22 bp, Homo sapiens
tgcctagatattttaggggtga

SEQ ID NO: 560870 - DNA, 22 bp, Homo sapiens
tatggtgggagaggaagatttc

SEQ ID NO: 560871 - DNA, 22 bp, Homo sapiens
agccacgccctcttggagatcg

SEQ ID NO: 560872 - DNA, 22 bp, Homo sapiens
tcattccctatggaatcccttc

SEQ ID NO: 560873 - DNA, 22 bp, Homo sapiens
taatcactagagcggggactca

SEQ ID NO: 560874 - DNA, 22 bp, Homo sapiens
ggaggagctggggaagctctgc

SEQ ID NO: 560875 - DNA, 22 bp, Homo sapiens
tctgtctttgtgtgcatctgtg

SEQ ID NO: 560876 - DNA, 22 bp, Homo sapiens
tgctacttacttgcattttaag

SEQ ID NO: 560877 - DNA, 22 bp, Homo sapiens
agtataaatctggatacttcat

SEQ ID NO: 560878 - DNA, 22 bp, Homo sapiens
ctaggctgctccatggatattc

SEQ ID NO: 560879 - DNA, 22 bp, Homo sapiens
tgccccccggagcgaagacccc

SEQ ID NO: 560880 - DNA, 22 bp, Homo sapiens
agtggtacaggaggctgattca

SEQ ID NO: 560881 - DNA, 22 bp, Homo sapiens
caagaaactgcacacacgcaag

SEQ ID NO: 560882 - DNA, 22 bp, Homo sapiens
tggctttctggtttatggagca

SEQ ID NO: 560883 - DNA, 22 bp, Homo sapiens
tgggagtgatgttacagcacta

SEQ ID NO: 560884 - DNA, 22 bp, Homo sapiens
gagtgaaggaagtcaaaggaat

SEQ ID NO: 560885 - DNA, 22 bp, Homo sapiens
acagggtcagcaggggagggtg

SEQ ID NO: 560886 - DNA, 22 bp, Homo sapiens
tgcatatgaatgcctccttaaa

SEQ ID NO: 560887 - DNA, 22 bp, Homo sapiens
tccctggccctgtcctggtggt

SEQ ID NO: 560888 - DNA, 22 bp, Homo sapiens
agtgggagagaaactttgggct

SEQ ID NO: 560889 - DNA, 22 bp, Homo sapiens
gaggctctggggttccctctgc

SEQ ID NO: 560890 - DNA, 22 bp, Homo sapiens
tggacattatctggggctggat

SEQ ID NO: 560891 - DNA, 22 bp, Homo sapiens
cccttgctgtgccttttcacat

SEQ ID NO: 560892 - DNA, 22 bp, Homo sapiens
tggtacctgggctgcagcccgg

SEQ ID NO: 560893 - DNA, 22 bp, Homo sapiens
tagggatctgagacttgggggt

SEQ ID NO: 560894 - DNA, 22 bp, Homo sapiens
tcttataaagaaaatataaatc

SEQ ID NO: 560895 - DNA, 22 bp, Homo sapiens
gcaagagcaatgtgataagtcc

SEQ ID NO: 560896 - DNA, 22 bp, Homo sapiens
ttattcaggctgtgtcagcagc

SEQ ID NO: 560897 - DNA, 22 bp, Homo sapiens
gggctgatgagcagatagtggg

SEQ ID NO: 560898 - DNA, 22 bp, Homo sapiens
gcccctctgacctcagagccga

SEQ ID NO: 560899 - DNA, 22 bp, Homo sapiens
tgccccacccccagccagctgc

SEQ ID NO: 560900 - DNA, 22 bp, Homo sapiens
aggcccaggagcagctgacctc

SEQ ID NO: 560901 - DNA, 22 bp, Homo sapiens
ttaaactacaaaactctttcga

SEQ ID NO: 560902 - DNA, 22 bp, Homo sapiens
gttagatgtggatgtttgcttc

SEQ ID NO: 560903 - DNA, 22 bp, Homo sapiens
ttttagtcaatatcaagattta

SEQ ID NO: 560904 - DNA, 22 bp, Homo sapiens
tcaagatgacagcaggactggc

SEQ ID NO: 560905 - DNA, 22 bp, Homo sapiens
tgagagttgggggaggataaga

SEQ ID NO: 560906 - DNA, 22 bp, Homo sapiens
gggagcagctagagggggtcct

SEQ ID NO: 560907 - DNA, 22 bp, Homo sapiens
ctctgagctcgtgcagtacttc

SEQ ID NO: 560908 - DNA, 22 bp, Homo sapiens
tatgtgcacacaagtgtgtgtt

SEQ ID NO: 560909 - DNA, 22 bp, Homo sapiens
tcaaagacactttggggaccac

SEQ ID NO: 560910 - DNA, 22 bp, Homo sapiens
tggccagaccgggaagggggag

SEQ ID NO: 560911 - DNA, 22 bp, Homo sapiens
taacctctttgatcaatagaaa

SEQ ID NO: 560912 - DNA, 22 bp, Homo sapiens
agcctcctctcctgataaccta

SEQ ID NO: 560913 - DNA, 22 bp, Homo sapiens
tggtggcaggtggcaggggcag

SEQ ID NO: 560914 - DNA, 22 bp, Homo sapiens
aaactgtccttcctagaggtgt

SEQ ID NO: 560915 - DNA, 22 bp, Homo sapiens
cactggaccctgggcaggctgg

SEQ ID NO: 560916 - DNA, 22 bp, Homo sapiens
aaaggcagaaccagggcatctt

SEQ ID NO: 560917 - DNA, 22 bp, Homo sapiens
tgtgctattccaaggccggggg

SEQ ID NO: 560918 - DNA, 22 bp, Homo sapiens
cgcgccgcaggttgcttaggag

SEQ ID NO: 560919 - DNA, 22 bp, Homo sapiens
aatggagttctgcaaagtactg

SEQ ID NO: 560920 - DNA, 22 bp, Homo sapiens
atgggttttcggaaatgaaagc

SEQ ID NO: 560921 - DNA, 22 bp, Homo sapiens
cagtgaggggctggtggggatt

SEQ ID NO: 560922 - DNA, 22 bp, Homo sapiens
ttttagtgctggaaggttgtct

SEQ ID NO: 560923 - DNA, 22 bp, Homo sapiens
caatgagaccagtgcaggaagg

SEQ ID NO: 560924 - DNA, 22 bp, Homo sapiens
ggaaatgccacctctgtgccct

SEQ ID NO: 560925 - DNA, 22 bp, Homo sapiens
ataatgtcttatcccagtgtgt

SEQ ID NO: 560926 - DNA, 22 bp, Homo sapiens
tggttctacatcttctgtgact

SEQ ID NO: 560927 - DNA, 22 bp, Homo sapiens
agcgggcatcatggggacagca

SEQ ID NO: 560928 - DNA, 22 bp, Homo sapiens
ggggtgtcctggcccagcctgg

SEQ ID NO: 560929 - DNA, 22 bp, Homo sapiens
tggaaattgtgcctccagatac

SEQ ID NO: 560930 - DNA, 22 bp, Homo sapiens
tgggatggactgaggctgggtg

SEQ ID NO: 560931 - DNA, 22 bp, Homo sapiens
cagcagccccagctccagcccc

SEQ ID NO: 560932 - DNA, 22 bp, Homo sapiens
agcgccctggagtaagctctcc

SEQ ID NO: 560933 - DNA, 22 bp, Homo sapiens
tccatgcctcctagaagttccg

SEQ ID NO: 560934 - DNA, 22 bp, Homo sapiens
taactggcacatatggaggtgg

SEQ ID NO: 560935 - DNA, 22 bp, Homo sapiens
tgcttaaggaagagtgatgaag

SEQ ID NO: 560936 - DNA, 22 bp, Homo sapiens
gaagatttttttttttactttt

SEQ ID NO: 560937 - DNA, 22 bp, Homo sapiens
ggccggctcagtggtcagcgct

SEQ ID NO: 560938 - DNA, 22 bp, Homo sapiens
tactcatattgattgcatttat

SEQ ID NO: 560939 - DNA, 22 bp, Homo sapiens
taggaagatggtttgctggcca

SEQ ID NO: 560940 - DNA, 22 bp, Homo sapiens
ttaaggaggtgcttactctcaa

SEQ ID NO: 560941 - DNA, 22 bp, Homo sapiens
tgtggagatggaacctgggtca

SEQ ID NO: 560942 - DNA, 22 bp, Homo sapiens
gctcagcggtggcagcagacga

SEQ ID NO: 560943 - DNA, 22 bp, Homo sapiens
cattgtccttgctgtttggaga

SEQ ID NO: 560944 - DNA, 22 bp, Homo sapiens
taattcatgcaaattgatccct

SEQ ID NO: 560945 - DNA, 22 bp, Homo sapiens
tgcaaagttgtatacacaaagc

SEQ ID NO: 560946 - DNA, 22 bp, Homo sapiens
tttcgtaactcctgacccaagc

SEQ ID NO: 560947 - DNA, 22 bp, Homo sapiens
gaggaagtggagaagattcagt

SEQ ID NO: 560948 - DNA, 22 bp, Homo sapiens
ttggccttctggtctgagttgc

SEQ ID NO: 560949 - DNA, 22 bp, Homo sapiens
tatattcttgattactttcttc

SEQ ID NO: 560950 - DNA, 22 bp, Homo sapiens
gtagtaaccacagtaatcacac

SEQ ID NO: 560951 - DNA, 22 bp, Homo sapiens
aactggattattacctcataaa

SEQ ID NO: 560952 - DNA, 22 bp, Homo sapiens
ccaggctgcaggtggaggctca

SEQ ID NO: 560953 - DNA, 22 bp, Homo sapiens
taatgcctgggtccttcctcag

SEQ ID NO: 560954 - DNA, 22 bp, Homo sapiens
gggccctggctccatctccttt

SEQ ID NO: 560955 - DNA, 22 bp, Homo sapiens
cagcaggatggccaattgccat

SEQ ID NO: 560956 - DNA, 22 bp, Homo sapiens
ttattggtttaattatagaaag

SEQ ID NO: 560957 - DNA, 22 bp, Homo sapiens
caaaatggcattcagcaacctt

SEQ ID NO: 560958 - DNA, 22 bp, Homo sapiens
caacgggtaaatgaaaaactct

SEQ ID NO: 560959 - DNA, 22 bp, Homo sapiens
gagggaggtttagaggaagtta

SEQ ID NO: 560960 - DNA, 22 bp, Homo sapiens
caaccaggcggcctgtgggaga

SEQ ID NO: 560961 - DNA, 22 bp, Homo sapiens
tctttattctttcattattctc

SEQ ID NO: 560962 - DNA, 22 bp, Homo sapiens
ttatcctccaaaataggccagt

SEQ ID NO: 560963 - DNA, 22 bp, Homo sapiens
gagcagtgaagggatttcctca

SEQ ID NO: 560964 - DNA, 22 bp, Homo sapiens
tattgtttaatatatatgtgtg

SEQ ID NO: 560965 - DNA, 22 bp, Homo sapiens
catttattgagcacctactgga

SEQ ID NO: 560966 - DNA, 22 bp, Homo sapiens
tccccccatctttcccatttac

SEQ ID NO: 560967 - DNA, 22 bp, Homo sapiens
tcctttatttggacctggtgcg

SEQ ID NO: 560968 - DNA, 22 bp, Homo sapiens
agttaatcttcttattgatcag

SEQ ID NO: 560969 - DNA, 22 bp, Homo sapiens
cctccaagctgcccagggacag

SEQ ID NO: 560970 - DNA, 22 bp, Homo sapiens
tgtgtcactgtgggcatagaaa

SEQ ID NO: 560971 - DNA, 22 bp, Homo sapiens
tcttcttgtgccttgtccacag

SEQ ID NO: 560972 - DNA, 22 bp, Homo sapiens
tgccactctgcttcctttatcc

SEQ ID NO: 560973 - DNA, 22 bp, Homo sapiens
tcggctgtataggtggatgctc

SEQ ID NO: 560974 - DNA, 22 bp, Homo sapiens
tagggtggagtgcttttcctcg

SEQ ID NO: 560975 - DNA, 22 bp, Homo sapiens
agtccatgtctaggtgaagagc

SEQ ID NO: 560976 - DNA, 22 bp, Homo sapiens
tagtgggtttggggtctgggct

SEQ ID NO: 560977 - DNA, 22 bp, Homo sapiens
agactggaaaatctctgcaggc

SEQ ID NO: 560978 - DNA, 22 bp, Homo sapiens
gagaccagtcgtgtctcagacg

SEQ ID NO: 560979 - DNA, 22 bp, Homo sapiens
tccattttacagatgaagaaag

SEQ ID NO: 560980 - DNA, 22 bp, Homo sapiens
gccactctgctgcctgtcgggt

SEQ ID NO: 560981 - DNA, 22 bp, Homo sapiens
tgggggcggggcgggtaggccg

SEQ ID NO: 560982 - DNA, 22 bp, Homo sapiens
tgaccccacctgctctcatttc

SEQ ID NO: 560983 - DNA, 22 bp, Homo sapiens
atcgtgcatccctttagagtgt

SEQ ID NO: 560984 - DNA, 22 bp, Homo sapiens
gacctaggctcagtgcagactt

SEQ ID NO: 560985 - DNA, 22 bp, Homo sapiens
tgtgacttcttcagtcctctgt

SEQ ID NO: 560986 - DNA, 22 bp, Homo sapiens
tatattgttgaaactacttgtt

SEQ ID NO: 560987 - DNA, 22 bp, Homo sapiens
gccccagcccctggggacagac

SEQ ID NO: 560988 - DNA, 22 bp, Homo sapiens
ggagagccccagcccctccggg

SEQ ID NO: 560989 - DNA, 22 bp, Homo sapiens
tctgcaccagccttctatctgt

SEQ ID NO: 560990 - DNA, 22 bp, Homo sapiens
tccatcttgggattcctgatgt

SEQ ID NO: 560991 - DNA, 22 bp, Homo sapiens
ttctacttcagaaatactatct

SEQ ID NO: 560992 - DNA, 22 bp, Homo sapiens
tttctcatgacacatccacagt

SEQ ID NO: 560993 - DNA, 22 bp, Homo sapiens
tgctaccatgaaggaagaagag

SEQ ID NO: 560994 - DNA, 22 bp, Homo sapiens
tgaaagtgtgtgaaagttattg

SEQ ID NO: 560995 - DNA, 22 bp, Homo sapiens
agctggcaggaaactttccaat

SEQ ID NO: 560996 - DNA, 22 bp, Homo sapiens
tagtttgtgacataagcagaac

SEQ ID NO: 560997 - DNA, 22 bp, Homo sapiens
tgtttcaaatgtgctcagggta

SEQ ID NO: 560998 - DNA, 22 bp, Homo sapiens
tgtacctaggttattgtattct

SEQ ID NO: 560999 - DNA, 22 bp, Homo sapiens
cttatttgttgttataataaac

SEQ ID NO: 561000 - DNA, 22 bp, Homo sapiens
tggatatgcatgcacaatttcc

SEQ ID NO: 561001 - DNA, 22 bp, Homo sapiens
tgtggtcgtttttgtggagggt

SEQ ID NO: 561002 - DNA, 22 bp, Homo sapiens
tgctggcttgttcacaggggag

SEQ ID NO: 561003 - DNA, 22 bp, Homo sapiens
ggaagcggagctggggagactg

SEQ ID NO: 561004 - DNA, 22 bp, Homo sapiens
caagatgcgggttaagggccag

SEQ ID NO: 561005 - DNA, 22 bp, Homo sapiens
gtgcctctggactagtctctgg

SEQ ID NO: 561006 - DNA, 22 bp, Homo sapiens
gatgatccagggcagagcttca

SEQ ID NO: 561007 - DNA, 22 bp, Homo sapiens
taggattttgcacttagtccag

SEQ ID NO: 561008 - DNA, 22 bp, Homo sapiens
tttggcaggagtaggagagaaa

SEQ ID NO: 561009 - DNA, 22 bp, Homo sapiens
tggagggagggaggaagggcct

SEQ ID NO: 561010 - DNA, 22 bp, Homo sapiens
ccctgctccaggtcacctgggg

SEQ ID NO: 561011 - DNA, 22 bp, Homo sapiens
ttgccaaagcactgagggagga

SEQ ID NO: 561012 - DNA, 22 bp, Homo sapiens
ccatcattctagatgcaaaact

SEQ ID NO: 561013 - DNA, 22 bp, Homo sapiens
tggtttgttttcctgctttgaa

SEQ ID NO: 561014 - DNA, 22 bp, Homo sapiens
tctgtgcccagaccagccctgc

SEQ ID NO: 561015 - DNA, 22 bp, Homo sapiens
gtcaacgtcacagggcgtgggg

SEQ ID NO: 561016 - DNA, 22 bp, Homo sapiens
tggggaaaatacatggtttccc

SEQ ID NO: 561017 - DNA, 22 bp, Homo sapiens
ggctggctgcgggcagccctcc

SEQ ID NO: 561018 - DNA, 22 bp, Homo sapiens
tctttggactttccaatttgtt

SEQ ID NO: 561019 - DNA, 22 bp, Homo sapiens
taatggggtggggaacagtcaa

SEQ ID NO: 561020 - DNA, 22 bp, Homo sapiens
acatggtaagtatacatcccag

SEQ ID NO: 561021 - DNA, 22 bp, Homo sapiens
tggggtcagaaagttctagatg

SEQ ID NO: 561022 - DNA, 22 bp, Homo sapiens
agccagctcccctggcaggcta

SEQ ID NO: 561023 - DNA, 22 bp, Homo sapiens
gttatgtctatggaagtgtcac

SEQ ID NO: 561024 - DNA, 22 bp, Homo sapiens
gaaatcaaggttgaattgtgct

SEQ ID NO: 561025 - DNA, 22 bp, Homo sapiens
ggattgacttgaagagtaggat

SEQ ID NO: 561026 - DNA, 22 bp, Homo sapiens
acgtgagtgtctgatggtggtg

SEQ ID NO: 561027 - DNA, 22 bp, Homo sapiens
ttatcacctgggtgactcagga

SEQ ID NO: 561028 - DNA, 22 bp, Homo sapiens
ttgagaaagggggctattcctt

SEQ ID NO: 561029 - DNA, 22 bp, Homo sapiens
cagaaatgccaggaatttatgt

SEQ ID NO: 561030 - DNA, 22 bp, Homo sapiens
tggtcagtagaatgttttgctt

SEQ ID NO: 561031 - DNA, 22 bp, Homo sapiens
ccattcttttggagttgcttaa

SEQ ID NO: 561032 - DNA, 22 bp, Homo sapiens
tgagagcctcccacctgagact

SEQ ID NO: 561033 - DNA, 22 bp, Homo sapiens
tcttttcctcctctttcttagc

SEQ ID NO: 561034 - DNA, 22 bp, Homo sapiens
ggtcttagatagcttgtcctgg

SEQ ID NO: 561035 - DNA, 22 bp, Homo sapiens
cttggcccatctcctccctcct

SEQ ID NO: 561036 - DNA, 22 bp, Homo sapiens
tctggccactgcctgaccctca

SEQ ID NO: 561037 - DNA, 22 bp, Homo sapiens
tagcccgggcctatggactaat

SEQ ID NO: 561038 - DNA, 22 bp, Homo sapiens
atggaagaggggaggctcagga

SEQ ID NO: 561039 - DNA, 22 bp, Homo sapiens
agattatcgattcctgaaaggg

SEQ ID NO: 561040 - DNA, 22 bp, Homo sapiens
atgtcacagggccccattgtgg

SEQ ID NO: 561041 - DNA, 22 bp, Homo sapiens
taagtgaagttatgttaactaa

SEQ ID NO: 561042 - DNA, 22 bp, Homo sapiens
agacaaaataggaatatatgga

SEQ ID NO: 561043 - DNA, 22 bp, Homo sapiens
aagcgcgatgccctctcctaga

SEQ ID NO: 561044 - DNA, 22 bp, Homo sapiens
ttgatgccacctgagggcctga

SEQ ID NO: 561045 - DNA, 22 bp, Homo sapiens
tatatgtttgttggctaataaa

SEQ ID NO: 561046 - DNA, 22 bp, Homo sapiens
tggccacagcttgtttgcaaag

SEQ ID NO: 561047 - DNA, 22 bp, Homo sapiens
gctatctctccactgcccccca

SEQ ID NO: 561048 - DNA, 22 bp, Homo sapiens
tatggtctttgggtagcagcag

SEQ ID NO: 561049 - DNA, 22 bp, Homo sapiens
ggtggggcccatggccttacac

SEQ ID NO: 561050 - DNA, 22 bp, Homo sapiens
cacctgcactccagccagggtg

SEQ ID NO: 561051 - DNA, 22 bp, Homo sapiens
ggcgtttcttgtctttgggtgg

SEQ ID NO: 561052 - DNA, 22 bp, Homo sapiens
caggcatcccaattaggattat

SEQ ID NO: 561053 - DNA, 22 bp, Homo sapiens
tggctaagcttccaaggccctc

SEQ ID NO: 561054 - DNA, 22 bp, Homo sapiens
tccttgacaaaaggttggcatt

SEQ ID NO: 561055 - DNA, 22 bp, Homo sapiens
taaggcagtggtcctccaatgc

SEQ ID NO: 561056 - DNA, 22 bp, Homo sapiens
gggcagcttgtgtcccgctggt

SEQ ID NO: 561057 - DNA, 22 bp, Homo sapiens
ctgggcaacctggccaagtctc

SEQ ID NO: 561058 - DNA, 22 bp, Homo sapiens
aaccagccaagaaagtggctgt

SEQ ID NO: 561059 - DNA, 22 bp, Homo sapiens
agtaatttctgctgaaaaggtt

SEQ ID NO: 561060 - DNA, 22 bp, Homo sapiens
agacttcagcttcttgagcaaa

SEQ ID NO: 561061 - DNA, 22 bp, Homo sapiens
tgagcccctgcctacctcatca

SEQ ID NO: 561062 - DNA, 22 bp, Homo sapiens
tcctttcttcagctacgcccat

SEQ ID NO: 561063 - DNA, 22 bp, Homo sapiens
gggggcttctcttgctgggctg

SEQ ID NO: 561064 - DNA, 22 bp, Homo sapiens
tctccttgatccctttggcttc

SEQ ID NO: 561065 - DNA, 22 bp, Homo sapiens
tccatcgcactcttttttttct

SEQ ID NO: 561066 - DNA, 22 bp, Homo sapiens
tcctgtcctgtccccctgccca

SEQ ID NO: 561067 - DNA, 22 bp, Homo sapiens
tccctacctcttctcctccctc

SEQ ID NO: 561068 - DNA, 22 bp, Homo sapiens
cagaaattggctctcacattcc

SEQ ID NO: 561069 - DNA, 22 bp, Homo sapiens
taatagaggtagtagctgaaat

SEQ ID NO: 561070 - DNA, 22 bp, Homo sapiens
tgaaatgtcatttctggaagtc

SEQ ID NO: 561071 - DNA, 22 bp, Homo sapiens
ttgctcatcttctcaccaggac

SEQ ID NO: 561072 - DNA, 22 bp, Homo sapiens
gctggatttttctctctgactt

SEQ ID NO: 561073 - DNA, 22 bp, Homo sapiens
ttgctgttcacttgaatgagga

SEQ ID NO: 561074 - DNA, 22 bp, Homo sapiens
atgatacaggtggaggtagaaa

SEQ ID NO: 561075 - DNA, 22 bp, Homo sapiens
tcctgattaggtttccatagct

SEQ ID NO: 561076 - DNA, 22 bp, Homo sapiens
ttgacctgaattctcgggattt

SEQ ID NO: 561077 - DNA, 22 bp, Homo sapiens
tctgtctcttggcctgtgtcct

SEQ ID NO: 561078 - DNA, 22 bp, Homo sapiens
tgtcatctatcttcccaaagaa

SEQ ID NO: 561079 - DNA, 22 bp, Homo sapiens
tgtagcaggccagagaatgagg

SEQ ID NO: 561080 - DNA, 22 bp, Homo sapiens
cagttcagtgggcttgctgagg

SEQ ID NO: 561081 - DNA, 22 bp, Homo sapiens
tatgcacatgaattttgttcat

SEQ ID NO: 561082 - DNA, 22 bp, Homo sapiens
tgggaatataatgaaaactctg

SEQ ID NO: 561083 - DNA, 22 bp, Homo sapiens
aagatacaatatgggtgtgtgt

SEQ ID NO: 561084 - DNA, 22 bp, Homo sapiens
tgtttctagtctggttttgtga

SEQ ID NO: 561085 - DNA, 22 bp, Homo sapiens
cagggagttgggaggtggcaag

SEQ ID NO: 561086 - DNA, 22 bp, Homo sapiens
tggcgctggcaaatgctggggt

SEQ ID NO: 561087 - DNA, 22 bp, Homo sapiens
tagtctaacaccataacctcag

SEQ ID NO: 561088 - DNA, 22 bp, Homo sapiens
ggaggcagagccaggtcctccc

SEQ ID NO: 561089 - DNA, 22 bp, Homo sapiens
ccagggaggttaagtagcttgc

SEQ ID NO: 561090 - DNA, 22 bp, Homo sapiens
ttagggagcttcatgagagagc

SEQ ID NO: 561091 - DNA, 22 bp, Homo sapiens
atgtgggagtgtcacatgctgc

SEQ ID NO: 561092 - DNA, 22 bp, Homo sapiens
gattattttgtatattcatgaa

SEQ ID NO: 561093 - DNA, 22 bp, Homo sapiens
ttcccttaccaggctcctcttt

SEQ ID NO: 561094 - DNA, 22 bp, Homo sapiens
tcagcaggcatgtttgtcaaat

SEQ ID NO: 561095 - DNA, 22 bp, Homo sapiens
cctatacctgcccctgggccag

SEQ ID NO: 561096 - DNA, 22 bp, Homo sapiens
tggtgactaagggtgtttgttg

SEQ ID NO: 561097 - DNA, 22 bp, Homo sapiens
tgtataatcttaatttgctttc

SEQ ID NO: 561098 - DNA, 22 bp, Homo sapiens
gcaagcccttgcctaccacact

SEQ ID NO: 561099 - DNA, 22 bp, Homo sapiens
gcaaacagcaggtgccacctgg

SEQ ID NO: 561100 - DNA, 22 bp, Homo sapiens
cttctgtctatttactctctct

SEQ ID NO: 561101 - DNA, 22 bp, Homo sapiens
tctgtgactttgagcaagttac

SEQ ID NO: 561102 - DNA, 22 bp, Homo sapiens
tgtaaataattctcagccaatt

SEQ ID NO: 561103 - DNA, 22 bp, Homo sapiens
ggtggtgcagtttcaatggggt

SEQ ID NO: 561104 - DNA, 22 bp, Homo sapiens
ggagaaatggggtctcaggatg

SEQ ID NO: 561105 - DNA, 22 bp, Homo sapiens
ttttctaacacggaagctgcat

SEQ ID NO: 561106 - DNA, 22 bp, Homo sapiens
caaattagagcctcccatttta

SEQ ID NO: 561107 - DNA, 22 bp, Homo sapiens
ctgggaggagcagccggctggc

SEQ ID NO: 561108 - DNA, 22 bp, Homo sapiens
ttctgtaaaggaagaagaggta

SEQ ID NO: 561109 - DNA, 22 bp, Homo sapiens
tatttcttcaggtctgcagagt

SEQ ID NO: 561110 - DNA, 22 bp, Homo sapiens
ctggcccgggagcagaggcctg

SEQ ID NO: 561111 - DNA, 22 bp, Homo sapiens
tgaattcctgcagtttcagctg

SEQ ID NO: 561112 - DNA, 22 bp, Homo sapiens
ccagtatctaattagcaaagcc

SEQ ID NO: 561113 - DNA, 22 bp, Homo sapiens
tcgcaagtggaggaaggctcat

SEQ ID NO: 561114 - DNA, 22 bp, Homo sapiens
tcactagatgtgagacccaggg

SEQ ID NO: 561115 - DNA, 22 bp, Homo sapiens
agcttacaatctagctgggggt

SEQ ID NO: 561116 - DNA, 22 bp, Homo sapiens
ctctgccttgagcagtgcccac

SEQ ID NO: 561117 - DNA, 22 bp, Homo sapiens
atgtatggaagcaaagatgtca

SEQ ID NO: 561118 - DNA, 22 bp, Homo sapiens
tctcttgtgctttcatagcagc

SEQ ID NO: 561119 - DNA, 22 bp, Homo sapiens
gcaccactgctgcccctgcccc

SEQ ID NO: 561120 - DNA, 22 bp, Homo sapiens
tgagctacctgtgcaagtaaat

SEQ ID NO: 561121 - DNA, 22 bp, Homo sapiens
ttgttccatccagggcagttgg

SEQ ID NO: 561122 - DNA, 22 bp, Homo sapiens
ctgattcccagtcatgctctct

SEQ ID NO: 561123 - DNA, 22 bp, Homo sapiens
agccctggggtgccccctcgcg

SEQ ID NO: 561124 - DNA, 22 bp, Homo sapiens
tccctttcctccccttactatg

SEQ ID NO: 561125 - DNA, 22 bp, Homo sapiens
agacccctgggggtttcctttc

SEQ ID NO: 561126 - DNA, 22 bp, Homo sapiens
aaaagtgacaaagatggtgcat

SEQ ID NO: 561127 - DNA, 22 bp, Homo sapiens
aatgttcaggtagggagccgga

SEQ ID NO: 561128 - DNA, 22 bp, Homo sapiens
tttatcgaaaattactaggcct

SEQ ID NO: 561129 - DNA, 22 bp, Homo sapiens
tggggggctactgacagaggag

SEQ ID NO: 561130 - DNA, 22 bp, Homo sapiens
tgttttccaggatggggtcctt

SEQ ID NO: 561131 - DNA, 22 bp, Homo sapiens
tgagtgggtgtttggatatata

SEQ ID NO: 561132 - DNA, 22 bp, Homo sapiens
accttgcctggggcccccgtgc

SEQ ID NO: 561133 - DNA, 22 bp, Homo sapiens
ttgctaagggtgatgatggggc

SEQ ID NO: 561134 - DNA, 22 bp, Homo sapiens
gacattggctgcgatgtgtgaa

SEQ ID NO: 561135 - DNA, 22 bp, Homo sapiens
taccaggcgaatcctactgggt

SEQ ID NO: 561136 - DNA, 22 bp, Homo sapiens
cgtttgctttgctcctgagcag

SEQ ID NO: 561137 - DNA, 22 bp, Homo sapiens
atctttcagaaggtgctgatga

SEQ ID NO: 561138 - DNA, 22 bp, Homo sapiens
gtttgagcaggaattcgaagcc

SEQ ID NO: 561139 - DNA, 22 bp, Homo sapiens
tggaaagcttgatctgacgctc

SEQ ID NO: 561140 - DNA, 22 bp, Homo sapiens
tctgtcccctaccccttccccc

SEQ ID NO: 561141 - DNA, 22 bp, Homo sapiens
aactagtaaaccatgtctcatt

SEQ ID NO: 561142 - DNA, 22 bp, Homo sapiens
aggcactgtgtgtgcacaaatc

SEQ ID NO: 561143 - DNA, 22 bp, Homo sapiens
tatcaaaacaattggttgattg

SEQ ID NO: 561144 - DNA, 22 bp, Homo sapiens
cctagttaccaattttactcgg

SEQ ID NO: 561145 - DNA, 22 bp, Homo sapiens
tgctgagattccagatctttgg

SEQ ID NO: 561146 - DNA, 22 bp, Homo sapiens
cagggtagtgtaatggagagag

SEQ ID NO: 561147 - DNA, 22 bp, Homo sapiens
tggtgggaaactgacagaatga

SEQ ID NO: 561148 - DNA, 22 bp, Homo sapiens
ggctgaggctgcagtacccacc

SEQ ID NO: 561149 - DNA, 22 bp, Homo sapiens
caaacatgacctggcagtgtag

SEQ ID NO: 561150 - DNA, 22 bp, Homo sapiens
tgcagttggtttagaatttcta

SEQ ID NO: 561151 - DNA, 22 bp, Homo sapiens
aggaaagagtgtatccatcaat

SEQ ID NO: 561152 - DNA, 22 bp, Homo sapiens
ggcccggccctcctctctccct

SEQ ID NO: 561153 - DNA, 22 bp, Homo sapiens
caggagctgctgggggtgctgg

SEQ ID NO: 561154 - DNA, 22 bp, Homo sapiens
tgtgtgtttctgtgggagtgtt

SEQ ID NO: 561155 - DNA, 22 bp, Homo sapiens
tgacaggttgggatatggaatg

SEQ ID NO: 561156 - DNA, 22 bp, Homo sapiens
taggcagtgtattgctagcggc

SEQ ID NO: 561157 - DNA, 22 bp, Homo sapiens
agaatatttgatggtttctgga

SEQ ID NO: 561158 - DNA, 22 bp, Homo sapiens
gaaatcaccaaactagaaaata

SEQ ID NO: 561159 - DNA, 22 bp, Homo sapiens
tgtcaacagctcacagaccaat

SEQ ID NO: 561160 - DNA, 22 bp, Homo sapiens
tgatggtgcctaagtcatttag

SEQ ID NO: 561161 - DNA, 22 bp, Homo sapiens
agccaggggccggagtgggagg

SEQ ID NO: 561162 - DNA, 22 bp, Homo sapiens
tcaatgtaacttgtcaagagcc

SEQ ID NO: 561163 - DNA, 22 bp, Homo sapiens
ggaggggcaagctggcagtgcc

SEQ ID NO: 561164 - DNA, 22 bp, Homo sapiens
ccccaccctcgctgtcccccgc

SEQ ID NO: 561165 - DNA, 22 bp, Homo sapiens
tgactgagttagggttggggtt

SEQ ID NO: 561166 - DNA, 22 bp, Homo sapiens
ttctctgtctcttatgtactta

SEQ ID NO: 561167 - DNA, 22 bp, Homo sapiens
tagtgcctaggtgacagggttg

SEQ ID NO: 561168 - DNA, 22 bp, Homo sapiens
tgggctctgggccggaggcgtc

SEQ ID NO: 561169 - DNA, 22 bp, Homo sapiens
tggaccggagggaggcggtggg

SEQ ID NO: 561170 - DNA, 22 bp, Homo sapiens
aaatatcttcaaagtagctatg

SEQ ID NO: 561171 - DNA, 22 bp, Homo sapiens
tttccccatagactccccacag

SEQ ID NO: 561172 - DNA, 22 bp, Homo sapiens
tccagtacatggggcaccgtgg

SEQ ID NO: 561173 - DNA, 22 bp, Homo sapiens
aatggggtctacattgcattct

SEQ ID NO: 561174 - DNA, 22 bp, Homo sapiens
tgagttatctaagtacagtcct

SEQ ID NO: 561175 - DNA, 22 bp, Homo sapiens
tgggagatgggcagataatctt

SEQ ID NO: 561176 - DNA, 22 bp, Homo sapiens
ttaagatccaaatgagataaag

SEQ ID NO: 561177 - DNA, 22 bp, Homo sapiens
gtggcactctgggggctcctct

SEQ ID NO: 561178 - DNA, 22 bp, Homo sapiens
ctggctctgctttacaaacagg

SEQ ID NO: 561179 - DNA, 22 bp, Homo sapiens
ggggagtggggcttcgacccta

SEQ ID NO: 561180 - DNA, 22 bp, Homo sapiens
agtttgaggatctaagacagat

SEQ ID NO: 561181 - DNA, 22 bp, Homo sapiens
gcatttgaaattgtttaacaat

SEQ ID NO: 561182 - DNA, 22 bp, Homo sapiens
atcgtgcatccttttagagtgt

SEQ ID NO: 561183 - DNA, 22 bp, Homo sapiens
gccccagggggttttgggggct

SEQ ID NO: 561184 - DNA, 22 bp, Homo sapiens
tgtaccatctttgtaacttttc

SEQ ID NO: 561185 - DNA, 22 bp, Homo sapiens
agtattctggcagtcattcagt

SEQ ID NO: 561186 - DNA, 22 bp, Homo sapiens
tgtcgtgtgttccctgaggggt

SEQ ID NO: 561187 - DNA, 22 bp, Homo sapiens
tgacctcagccagctaacctgc

SEQ ID NO: 561188 - DNA, 22 bp, Homo sapiens
gccagtgagtgacagcagagac

SEQ ID NO: 561189 - DNA, 22 bp, Homo sapiens
aaagaacatctaggtctaagtt

SEQ ID NO: 561190 - DNA, 22 bp, Homo sapiens
tagaggtggagcgaagtggggc

SEQ ID NO: 561191 - DNA, 22 bp, Homo sapiens
tcctctagcatcctcatgcccg

SEQ ID NO: 561192 - DNA, 22 bp, Homo sapiens
ttttaaataagcatcttgtggg

SEQ ID NO: 561193 - DNA, 22 bp, Homo sapiens
tggctttctaggctggactttc

SEQ ID NO: 561194 - DNA, 22 bp, Homo sapiens
gaaggcggttccggttcgcggc

SEQ ID NO: 561195 - DNA, 22 bp, Homo sapiens
cgagggcacccagctgaccttg

SEQ ID NO: 561196 - DNA, 22 bp, Homo sapiens
tctattcataggccgcattttt

SEQ ID NO: 561197 - DNA, 22 bp, Homo sapiens
cagctttcacacagtgctctag

SEQ ID NO: 561198 - DNA, 22 bp, Homo sapiens
taatttactgagtgctacctaa

SEQ ID NO: 561199 - DNA, 22 bp, Homo sapiens
cacctcagccatgtggaggcgg

SEQ ID NO: 561200 - DNA, 22 bp, Homo sapiens
tgcaaagaagaagggaaaggag

SEQ ID NO: 561201 - DNA, 22 bp, Homo sapiens
agatgtgggacagagctcctcg

SEQ ID NO: 561202 - DNA, 22 bp, Homo sapiens
agggaaatcagatcagtgccgt

SEQ ID NO: 561203 - DNA, 22 bp, Homo sapiens
aacagttggaagggcctggatc

SEQ ID NO: 561204 - DNA, 22 bp, Homo sapiens
gctggctgtcctctgtgaagat

SEQ ID NO: 561205 - DNA, 22 bp, Homo sapiens
tctgccctggtgctcttctgtc

SEQ ID NO: 561206 - DNA, 22 bp, Homo sapiens
tcagagttgactcctgctcctg

SEQ ID NO: 561207 - DNA, 22 bp, Homo sapiens
tcatttgctagttctgcctgat

SEQ ID NO: 561208 - DNA, 22 bp, Homo sapiens
agtccccgctctagtgattaca

SEQ ID NO: 561209 - DNA, 22 bp, Homo sapiens
ttcctgtcctgccctggctgag

SEQ ID NO: 561210 - DNA, 22 bp, Homo sapiens
cctccccggggccagagggcag

SEQ ID NO: 561211 - DNA, 22 bp, Homo sapiens
tcgttccccccaccccacttgg

SEQ ID NO: 561212 - DNA, 22 bp, Homo sapiens
ccttctcagagctgtagccttg

SEQ ID NO: 561213 - DNA, 22 bp, Homo sapiens
atggggtgatgagaggagagca

SEQ ID NO: 561214 - DNA, 22 bp, Homo sapiens
tactatttggatgttagcctca

SEQ ID NO: 561215 - DNA, 22 bp, Homo sapiens
tttaatcaaagaactgggtgtt

SEQ ID NO: 561216 - DNA, 22 bp, Homo sapiens
aatggtttaaacttgttagtca

SEQ ID NO: 561217 - DNA, 22 bp, Homo sapiens
tgaccaatggcatcaaagagct

SEQ ID NO: 561218 - DNA, 22 bp, Homo sapiens
tgtagcaccccagcttctccct

SEQ ID NO: 561219 - DNA, 22 bp, Homo sapiens
taggcagagaggccataagaat

SEQ ID NO: 561220 - DNA, 22 bp, Homo sapiens
cctatgccttttgaccataatc

SEQ ID NO: 561221 - DNA, 22 bp, Homo sapiens
tccatgtgggctggtgcctccc

SEQ ID NO: 561222 - DNA, 22 bp, Homo sapiens
ggcgggggtaggggccgggatg

SEQ ID NO: 561223 - DNA, 22 bp, Homo sapiens
ggcttcagcagcactgaacatt

SEQ ID NO: 561224 - DNA, 22 bp, Homo sapiens
gatcccagaatcaaatcaggtg

SEQ ID NO: 561225 - DNA, 22 bp, Homo sapiens
gcatctggcccacaaagcccgg

SEQ ID NO: 561226 - DNA, 22 bp, Homo sapiens
acaaccttctagggcacagacg

SEQ ID NO: 561227 - DNA, 22 bp, Homo sapiens
aacaaatggcactataattcct

SEQ ID NO: 561228 - DNA, 22 bp, Homo sapiens
ggcctttaggttgtaagcacat

SEQ ID NO: 561229 - DNA, 22 bp, Homo sapiens
aggttctgctctgggctgaaga

SEQ ID NO: 561230 - DNA, 22 bp, Homo sapiens
actcctagacctattcctgaac

SEQ ID NO: 561231 - DNA, 22 bp, Homo sapiens
tggtgccttgaaagagctgatt

SEQ ID NO: 561232 - DNA, 22 bp, Homo sapiens
gacagaaaggatggttgtctcc

SEQ ID NO: 561233 - DNA, 22 bp, Homo sapiens
attctatctgtttactctctat

SEQ ID NO: 561234 - DNA, 22 bp, Homo sapiens
tcatgaatgaccaaagcaaaat

SEQ ID NO: 561235 - DNA, 22 bp, Homo sapiens
agttggaggcgttccctgacct

SEQ ID NO: 561236 - DNA, 22 bp, Homo sapiens
agaggttgtacctaaagtgttc

SEQ ID NO: 561237 - DNA, 22 bp, Homo sapiens
tgcatgtacccacacaggccca

SEQ ID NO: 561238 - DNA, 22 bp, Homo sapiens
cagctggggcccgagagatggt

SEQ ID NO: 561239 - DNA, 22 bp, Homo sapiens
ttgtggggaggagggagagtta

SEQ ID NO: 561240 - DNA, 22 bp, Homo sapiens
tcagtgaaccttcaccaaaccc

SEQ ID NO: 561241 - DNA, 22 bp, Homo sapiens
ttaggaaaaataaaaggcagtg

SEQ ID NO: 561242 - DNA, 22 bp, Homo sapiens
cggcgcgagcctcgggccgggc

SEQ ID NO: 561243 - DNA, 22 bp, Homo sapiens
tataggtaacccacagacatta

SEQ ID NO: 561244 - DNA, 22 bp, Homo sapiens
agcaatttgagcaagttctatc

SEQ ID NO: 561245 - DNA, 22 bp, Homo sapiens
tctggcttctcccatccagctc

SEQ ID NO: 561246 - DNA, 22 bp, Homo sapiens
tctttccacttggcttctcttg

SEQ ID NO: 561247 - DNA, 22 bp, Homo sapiens
taaatgccagcctgctcattac

SEQ ID NO: 561248 - DNA, 22 bp, Homo sapiens
agaagaggcacaaatgctacac

SEQ ID NO: 561249 - DNA, 22 bp, Homo sapiens
tttcttggccccagctagcaca

SEQ ID NO: 561250 - DNA, 22 bp, Homo sapiens
cactgtattgagatttcattgt

SEQ ID NO: 561251 - DNA, 22 bp, Homo sapiens
tttgaccctgttattctccctg

SEQ ID NO: 561252 - DNA, 22 bp, Homo sapiens
agagggtttgggaagagcaaga

SEQ ID NO: 561253 - DNA, 22 bp, Homo sapiens
tgggagctgccacctggccttc

SEQ ID NO: 561254 - DNA, 22 bp, Homo sapiens
tatcttgtaaatattatgtggt

SEQ ID NO: 561255 - DNA, 22 bp, Homo sapiens
ggttgatgcaaaagtaagtgtg

SEQ ID NO: 561256 - DNA, 22 bp, Homo sapiens
tcacaatatagtggaagacaca

SEQ ID NO: 561257 - DNA, 22 bp, Homo sapiens
tacatggttgtttttatggagc

SEQ ID NO: 561258 - DNA, 22 bp, Homo sapiens
ttccagagacagttcacactac

SEQ ID NO: 561259 - DNA, 22 bp, Homo sapiens
tggcagatgtgttgtgtgggag

SEQ ID NO: 561260 - DNA, 22 bp, Homo sapiens
tgccagatcagaatagtgtatt

SEQ ID NO: 561261 - DNA, 22 bp, Homo sapiens
gaggggctgcgtgctgaggtaa

SEQ ID NO: 561262 - DNA, 22 bp, Homo sapiens
tctctgcctacttcacagagat

SEQ ID NO: 561263 - DNA, 22 bp, Homo sapiens
cacgcacttattggacatgcgt

SEQ ID NO: 561264 - DNA, 22 bp, Homo sapiens
actgctcccgggcctcctttct

SEQ ID NO: 561265 - DNA, 22 bp, Homo sapiens
agattaaagtgggattcttgcc

SEQ ID NO: 561266 - DNA, 22 bp, Homo sapiens
gcagatggaggaagtgaggagc

SEQ ID NO: 561267 - DNA, 22 bp, Homo sapiens
tccttcctgacactgatggatg

SEQ ID NO: 561268 - DNA, 22 bp, Homo sapiens
gaccatgcactgattcagacaa

SEQ ID NO: 561269 - DNA, 22 bp, Homo sapiens
tgattggttggatttcccagtg

SEQ ID NO: 561270 - DNA, 22 bp, Homo sapiens
tctgctcagctgttttgtttcc

SEQ ID NO: 561271 - DNA, 22 bp, Homo sapiens
tcgtcagctttgtgctgcttct

SEQ ID NO: 561272 - DNA, 22 bp, Homo sapiens
cactggacttcccaatcccgag

SEQ ID NO: 561273 - DNA, 22 bp, Homo sapiens
ggccccctggggtctccttgtg

SEQ ID NO: 561274 - DNA, 22 bp, Homo sapiens
tacctatgcacaatagggtgca

SEQ ID NO: 561275 - DNA, 22 bp, Homo sapiens
tggggcgcccgccttgaggttt

SEQ ID NO: 561276 - DNA, 22 bp, Homo sapiens
tggtggggagaggggagggaat

SEQ ID NO: 561277 - DNA, 22 bp, Homo sapiens
actgtcatctgagtctctgcag

SEQ ID NO: 561278 - DNA, 22 bp, Homo sapiens
caaggtgggttttgcattgtcc

SEQ ID NO: 561279 - DNA, 22 bp, Homo sapiens
tacccattgcatatcggagttg

SEQ ID NO: 561280 - DNA, 22 bp, Homo sapiens
ctagatgtgctagtgtatccag

SEQ ID NO: 561281 - DNA, 22 bp, Homo sapiens
gggtcttgcaggcagagcgtgg

SEQ ID NO: 561282 - DNA, 22 bp, Homo sapiens
tttgctctccttcctctgccca

SEQ ID NO: 561283 - DNA, 22 bp, Homo sapiens
tccccagtgctgtgagtggcat

SEQ ID NO: 561284 - DNA, 22 bp, Homo sapiens
tgattgcagctgcatggctatt

SEQ ID NO: 561285 - DNA, 22 bp, Homo sapiens
tggctcgtttttcttgaaaggc

SEQ ID NO: 561286 - DNA, 22 bp, Homo sapiens
ttagagttcaggagaataagat

SEQ ID NO: 561287 - DNA, 22 bp, Homo sapiens
tttgatgagaacatctggggcc

SEQ ID NO: 561288 - DNA, 22 bp, Homo sapiens
tggggcagggggcccaggacag

SEQ ID NO: 561289 - DNA, 22 bp, Homo sapiens
aaatagccttggtttgtgcacc

SEQ ID NO: 561290 - DNA, 22 bp, Homo sapiens
gggagcccggaccgaaagctca

SEQ ID NO: 561291 - DNA, 22 bp, Homo sapiens
tcttgtaccttgcagcacactc

SEQ ID NO: 561292 - DNA, 22 bp, Homo sapiens
tggcagtttctggcatcagctt

SEQ ID NO: 561293 - DNA, 22 bp, Homo sapiens
atttagaatgtgtgtaataatt

SEQ ID NO: 561294 - DNA, 22 bp, Homo sapiens
tggactacaactcccggcaggc

SEQ ID NO: 561295 - DNA, 22 bp, Homo sapiens
cgcacactgctcccaggacagc

SEQ ID NO: 561296 - DNA, 22 bp, Homo sapiens
gggcaggctccaagcatcctat

SEQ ID NO: 561297 - DNA, 22 bp, Homo sapiens
tattgtcttaggtcttacaaaa

SEQ ID NO: 561298 - DNA, 22 bp, Homo sapiens
tgttgagcgagaatcttgcctg

SEQ ID NO: 561299 - DNA, 22 bp, Homo sapiens
tgtactgaaccagaatatatga

SEQ ID NO: 561300 - DNA, 22 bp, Homo sapiens
ccagaaagcctgggacaaagcc

SEQ ID NO: 561301 - DNA, 22 bp, Homo sapiens
tagtaggttggggtttgtgctg

SEQ ID NO: 561302 - DNA, 22 bp, Homo sapiens
tgaatccctaacttttcccatc

SEQ ID NO: 561303 - DNA, 22 bp, Homo sapiens
cacctctccctcacccccagcc

SEQ ID NO: 561304 - DNA, 22 bp, Homo sapiens
ttactgttggacatgtgtggct

SEQ ID NO: 561305 - DNA, 22 bp, Homo sapiens
actgaggggatatggaaagtga

SEQ ID NO: 561306 - DNA, 22 bp, Homo sapiens
cccagggaggcccagggttgga

SEQ ID NO: 561307 - DNA, 22 bp, Homo sapiens
cagtgactgagcgtggggggtg

SEQ ID NO: 561308 - DNA, 22 bp, Homo sapiens
ggtttcctggaaagttctgtgg

SEQ ID NO: 561309 - DNA, 22 bp, Homo sapiens
tgggggcttgtgtcactgtgag

SEQ ID NO: 561310 - DNA, 22 bp, Homo sapiens
tcttgcctacattattgggacg

SEQ ID NO: 561311 - DNA, 22 bp, Homo sapiens
cagaagatggggtagagtcagg

SEQ ID NO: 561312 - DNA, 22 bp, Homo sapiens
tgaagcataaagataaatttct

SEQ ID NO: 561313 - DNA, 22 bp, Homo sapiens
agtggaggtgggagggaacaag

SEQ ID NO: 561314 - DNA, 22 bp, Homo sapiens
gcatgtgtcgccttttatagca

SEQ ID NO: 561315 - DNA, 22 bp, Homo sapiens
tcctcttccttctgagttcctc

SEQ ID NO: 561316 - DNA, 22 bp, Homo sapiens
gacaggcctgagacatctgaga

SEQ ID NO: 561317 - DNA, 22 bp, Homo sapiens
gggccagggacgtcaccaactt

SEQ ID NO: 561318 - DNA, 22 bp, Homo sapiens
caaggcgccgggccagcttcac

SEQ ID NO: 561319 - DNA, 22 bp, Homo sapiens
aaaagctgctcagattctttta

SEQ ID NO: 561320 - DNA, 22 bp, Homo sapiens
tggggcaaggggtttgtctgga

SEQ ID NO: 561321 - DNA, 22 bp, Homo sapiens
tcataattatttctccctgtgg

SEQ ID NO: 561322 - DNA, 22 bp, Homo sapiens
tgctgctctggccaggaactgc

SEQ ID NO: 561323 - DNA, 22 bp, Homo sapiens
gaatgcctactggttacctcgg

SEQ ID NO: 561324 - DNA, 22 bp, Homo sapiens
tgagaactgaattccataggct

SEQ ID NO: 561325 - DNA, 22 bp, Homo sapiens
ggtagctgtggctggctgggtt

SEQ ID NO: 561326 - DNA, 22 bp, Homo sapiens
gcccatgattgccttgttttag

SEQ ID NO: 561327 - DNA, 22 bp, Homo sapiens
ccagctggtggaggctcagcca

SEQ ID NO: 561328 - DNA, 22 bp, Homo sapiens
tgaggttggggcttgggcttcc

SEQ ID NO: 561329 - DNA, 22 bp, Homo sapiens
gcccagctctttcagggagtgt

SEQ ID NO: 561330 - DNA, 22 bp, Homo sapiens
tactgtggaactgcttctggtg

SEQ ID NO: 561331 - DNA, 22 bp, Homo sapiens
ttggaagatcttggctcttttg

SEQ ID NO: 561332 - DNA, 22 bp, Homo sapiens
ggggaatggtggggccctctct

SEQ ID NO: 561333 - DNA, 22 bp, Homo sapiens
ggttgtttttcttgtcacaatt

SEQ ID NO: 561334 - DNA, 22 bp, Homo sapiens
tgggttcattattcttgggcgt

SEQ ID NO: 561335 - DNA, 22 bp, Homo sapiens
tgatgtgttggtgagacaaact

SEQ ID NO: 561336 - DNA, 22 bp, Homo sapiens
tcacactgcaaggtggtgccct

SEQ ID NO: 561337 - DNA, 22 bp, Homo sapiens
tgtgtgtatgtgtgtgcatatg

SEQ ID NO: 561338 - DNA, 22 bp, Homo sapiens
gacgaagaggtttgcaactaag

SEQ ID NO: 561339 - DNA, 22 bp, Homo sapiens
ttcaagatctgtccagaccatt

SEQ ID NO: 561340 - DNA, 22 bp, Homo sapiens
tcatcattttcatatgagatgt

SEQ ID NO: 561341 - DNA, 22 bp, Homo sapiens
gggtcagaaatcctgctgtcag

SEQ ID NO: 561342 - DNA, 22 bp, Homo sapiens
cacttcactgcctgcagacaag

SEQ ID NO: 561343 - DNA, 22 bp, Homo sapiens
tgtctttgaatgggggtaattg

SEQ ID NO: 561344 - DNA, 22 bp, Homo sapiens
tttccaagtttcatccttatcc

SEQ ID NO: 561345 - DNA, 22 bp, Homo sapiens
tgtgatctctgtagggactaag

SEQ ID NO: 561346 - DNA, 22 bp, Homo sapiens
ttgtggggtcggggtcctttgg

SEQ ID NO: 561347 - DNA, 22 bp, Homo sapiens
agtacaaggaaggctgagaaaa

SEQ ID NO: 561348 - DNA, 22 bp, Homo sapiens
aggatgtgccctcaaggaatgt

SEQ ID NO: 561349 - DNA, 22 bp, Homo sapiens
tgtagtgcactctactctgtgt

SEQ ID NO: 561350 - DNA, 22 bp, Homo sapiens
catctgttcaaacataatgctc

SEQ ID NO: 561351 - DNA, 22 bp, Homo sapiens
gagcatcccagggaaactccaa

SEQ ID NO: 561352 - DNA, 22 bp, Homo sapiens
gaagtgtagacaaggtgggagt

SEQ ID NO: 561353 - DNA, 22 bp, Homo sapiens
ggggacaggagggcgccggatc

SEQ ID NO: 561354 - DNA, 22 bp, Homo sapiens
agcttctttcatacccccaaat

SEQ ID NO: 561355 - DNA, 22 bp, Homo sapiens
aggtctctgaggtcagagggtg

SEQ ID NO: 561356 - DNA, 22 bp, Homo sapiens
gatgactgtggtgtagggtggc

SEQ ID NO: 561357 - DNA, 22 bp, Homo sapiens
tctcgtattagatttttacttc

SEQ ID NO: 561358 - DNA, 22 bp, Homo sapiens
tggctacttcaggctggcagtt

SEQ ID NO: 561359 - DNA, 22 bp, Homo sapiens
ttcccaagttcatgtcactggg

SEQ ID NO: 561360 - DNA, 22 bp, Homo sapiens
cctggaactaagttggtcattg

SEQ ID NO: 561361 - DNA, 22 bp, Homo sapiens
tgttctacctaaatagctctga

SEQ ID NO: 561362 - DNA, 22 bp, Homo sapiens
tgtcatatgtactatggctgac

SEQ ID NO: 561363 - DNA, 22 bp, Homo sapiens
cacttcaggactgtgggaaagt

SEQ ID NO: 561364 - DNA, 22 bp, Homo sapiens
taatagcatgttgtcacatctc

SEQ ID NO: 561365 - DNA, 22 bp, Homo sapiens
tcaagtgaaaattaatggcaaa

SEQ ID NO: 561366 - DNA, 22 bp, Homo sapiens
ttgcagatgtgttgctaattgt

SEQ ID NO: 561367 - DNA, 22 bp, Homo sapiens
tatatatcaggagtaagatcta

SEQ ID NO: 561368 - DNA, 22 bp, Homo sapiens
gaggtgggcgtggggctgaagg

SEQ ID NO: 561369 - DNA, 22 bp, Homo sapiens
agtttaggtgaattctagggtc

SEQ ID NO: 561370 - DNA, 22 bp, Homo sapiens
tctttgacaagagaggattagg

SEQ ID NO: 561371 - DNA, 22 bp, Homo sapiens
cgaagtttcttcctaaaccagc

SEQ ID NO: 561372 - DNA, 22 bp, Homo sapiens
tgtaaattaatctatagtatag

SEQ ID NO: 561373 - DNA, 22 bp, Homo sapiens
tctcttaggactgttcaagggc

SEQ ID NO: 561374 - DNA, 22 bp, Homo sapiens
tctcagccctggggcttgtctc

SEQ ID NO: 561375 - DNA, 22 bp, Homo sapiens
tagactctggtctctagagctc

SEQ ID NO: 561376 - DNA, 22 bp, Homo sapiens
tggataagtgaccccccagcta

SEQ ID NO: 561377 - DNA, 22 bp, Homo sapiens
gggttgaggcggatgtcggcgg

SEQ ID NO: 561378 - DNA, 22 bp, Homo sapiens
ggatgaaaagacaattgaaaaa

SEQ ID NO: 561379 - DNA, 22 bp, Homo sapiens
cttggcactgcgtgaccttggg

SEQ ID NO: 561380 - DNA, 22 bp, Homo sapiens
tggagttgagaaagacagagcg

SEQ ID NO: 561381 - DNA, 22 bp, Homo sapiens
acctgcagagaagcttcagggg

SEQ ID NO: 561382 - DNA, 22 bp, Homo sapiens
tgaggagaacagattctgtttt

SEQ ID NO: 561383 - DNA, 22 bp, Homo sapiens
aaaaatgtctgatactcctgga

SEQ ID NO: 561384 - DNA, 22 bp, Homo sapiens
gccacacggggtaataataact

SEQ ID NO: 561385 - DNA, 22 bp, Homo sapiens
ttttccttagggacctgtgttt

SEQ ID NO: 561386 - DNA, 22 bp, Homo sapiens
tggtgagagggttctttccccc

SEQ ID NO: 561387 - DNA, 22 bp, Homo sapiens
gacaaacctcatttcctttctg

SEQ ID NO: 561388 - DNA, 22 bp, Homo sapiens
tggaaggttagtggtccagaaa

SEQ ID NO: 561389 - DNA, 22 bp, Homo sapiens
tcactggagtttgtttcaatat

SEQ ID NO: 561390 - DNA, 22 bp, Homo sapiens
tgctctgagaactccacaatgt

SEQ ID NO: 561391 - DNA, 22 bp, Homo sapiens
gcagggagagttgctttccttt

SEQ ID NO: 561392 - DNA, 22 bp, Homo sapiens
agcagtttcagactttccatat

SEQ ID NO: 561393 - DNA, 22 bp, Homo sapiens
gattttataggcttcataaact

SEQ ID NO: 561394 - DNA, 22 bp, Homo sapiens
caacaacttagacacgtgactg

SEQ ID NO: 561395 - DNA, 22 bp, Homo sapiens
cgagttttatttttatacacct

SEQ ID NO: 561396 - DNA, 22 bp, Homo sapiens
aatgagcttgtctgtgccccga

SEQ ID NO: 561397 - DNA, 22 bp, Homo sapiens
tgtttgactcggtagttttatt

SEQ ID NO: 561398 - DNA, 22 bp, Homo sapiens
tttgcttgactacatcagtgag

SEQ ID NO: 561399 - DNA, 22 bp, Homo sapiens
tgtgtgcagatgatctcatctc

SEQ ID NO: 561400 - DNA, 22 bp, Homo sapiens
aagtagaagcatttgcattctg

SEQ ID NO: 561401 - DNA, 22 bp, Homo sapiens
tgaaggctgaagcagcgtgtgg

SEQ ID NO: 561402 - DNA, 22 bp, Homo sapiens
cccccagggagtgcccagggca

SEQ ID NO: 561403 - DNA, 22 bp, Homo sapiens
tgggaaagagaaagaacaagta

SEQ ID NO: 561404 - DNA, 22 bp, Homo sapiens
gcctctgcacttggatcttctc

SEQ ID NO: 561405 - DNA, 22 bp, Homo sapiens
tccacccccaagcctcttggta

SEQ ID NO: 561406 - DNA, 22 bp, Homo sapiens
accatttaacagccttttaaag

SEQ ID NO: 561407 - DNA, 22 bp, Homo sapiens
tcattctgtgcatgtgtttcag

SEQ ID NO: 561408 - DNA, 22 bp, Homo sapiens
cactccacctccagctgctcca

SEQ ID NO: 561409 - DNA, 22 bp, Homo sapiens
gacagatggcaggaagcagtgg

SEQ ID NO: 561410 - DNA, 22 bp, Homo sapiens
gcagggaggaggcgggtggagg

SEQ ID NO: 561411 - DNA, 22 bp, Homo sapiens
gacagcactgggggactgggat

SEQ ID NO: 561412 - DNA, 22 bp, Homo sapiens
tagtggtgagttgctttgttta

SEQ ID NO: 561413 - DNA, 22 bp, Homo sapiens
tgggaagttgattggaagctag

SEQ ID NO: 561414 - DNA, 22 bp, Homo sapiens
gcacatttattacatacggggc

SEQ ID NO: 561415 - DNA, 22 bp, Homo sapiens
gcgctgctgggctgggggatga

SEQ ID NO: 561416 - DNA, 22 bp, Homo sapiens
ggccaactctgtctgtctggtg

SEQ ID NO: 561417 - DNA, 22 bp, Homo sapiens
ttacttcctgggcatctacaca

SEQ ID NO: 561418 - DNA, 22 bp, Homo sapiens
acctcagaggttggtgacttac

SEQ ID NO: 561419 - DNA, 22 bp, Homo sapiens
tagattgagataaatgtgtgta

SEQ ID NO: 561420 - DNA, 22 bp, Homo sapiens
tctccaggagttccctggaagg

SEQ ID NO: 561421 - DNA, 22 bp, Homo sapiens
tccccggggtcttgctgctgga

SEQ ID NO: 561422 - DNA, 22 bp, Homo sapiens
ggcacctgccgccttttctgtt

SEQ ID NO: 561423 - DNA, 22 bp, Homo sapiens
tgagctctgtaacacagtgctg

SEQ ID NO: 561424 - DNA, 22 bp, Homo sapiens
aggtccctggaggtattgtcag

SEQ ID NO: 561425 - DNA, 22 bp, Homo sapiens
gttagttatgcaggtaatttcc

SEQ ID NO: 561426 - DNA, 22 bp, Homo sapiens
cacacagatagatgatgttagc

SEQ ID NO: 561427 - DNA, 22 bp, Homo sapiens
ttgcaaattgatgtgtaaatgt

SEQ ID NO: 561428 - DNA, 22 bp, Homo sapiens
ggaagggagtggggctgtgcag

SEQ ID NO: 561429 - DNA, 22 bp, Homo sapiens
tactatttctttattactgact

SEQ ID NO: 561430 - DNA, 22 bp, Homo sapiens
agccctgactgtcatggaagct

SEQ ID NO: 561431 - DNA, 22 bp, Homo sapiens
taatgaaatataaaacaaagat

SEQ ID NO: 561432 - DNA, 22 bp, Homo sapiens
tctcctggtccctccctccgtc

SEQ ID NO: 561433 - DNA, 22 bp, Homo sapiens
tggtaactctaatttgggtaag

SEQ ID NO: 561434 - DNA, 22 bp, Homo sapiens
tggtagttggggtcgggtttgt

SEQ ID NO: 561435 - DNA, 22 bp, Homo sapiens
gaaggggtgagttgggaggggt

SEQ ID NO: 561436 - DNA, 22 bp, Homo sapiens
tgctctggcccagagcgcacgt

SEQ ID NO: 561437 - DNA, 22 bp, Homo sapiens
gctgtaagtacttaggagggag

SEQ ID NO: 561438 - DNA, 22 bp, Homo sapiens
tttcccagtgagcctgggctcg

SEQ ID NO: 561439 - DNA, 22 bp, Homo sapiens
tgtgtcctagtcaggagaggca

SEQ ID NO: 561440 - DNA, 22 bp, Homo sapiens
tgtatgcttgccatttaaaatg

SEQ ID NO: 561441 - DNA, 22 bp, Homo sapiens
caatattcctaaatgagtaaca

SEQ ID NO: 561442 - DNA, 22 bp, Homo sapiens
ggattggccccagcgccaggtg

SEQ ID NO: 561443 - DNA, 22 bp, Homo sapiens
ctaaaagttctggaatgatttc

SEQ ID NO: 561444 - DNA, 22 bp, Homo sapiens
tcaggccttggtaaatcctctc

SEQ ID NO: 561445 - DNA, 22 bp, Homo sapiens
gaagttaagtagcatccctgat

SEQ ID NO: 561446 - DNA, 22 bp, Homo sapiens
accacagggaagccaaaatgta

SEQ ID NO: 561447 - DNA, 22 bp, Homo sapiens
tttccaattctactgtgaatta

SEQ ID NO: 561448 - DNA, 22 bp, Homo sapiens
tgcttcaatacacagtgcccta

SEQ ID NO: 561449 - DNA, 22 bp, Homo sapiens
ttttgcatccaccctctccctc

SEQ ID NO: 561450 - DNA, 22 bp, Homo sapiens
gggtgatcttcacgtaagcctg

SEQ ID NO: 561451 - DNA, 22 bp, Homo sapiens
gttattcatgtacttggcatcg

SEQ ID NO: 561452 - DNA, 22 bp, Homo sapiens
gagcttggagtccagctgggca

SEQ ID NO: 561453 - DNA, 22 bp, Homo sapiens
tgggtgtctcagagtctcctgg

SEQ ID NO: 561454 - DNA, 22 bp, Homo sapiens
tcccttcgttcccccccacccc

SEQ ID NO: 561455 - DNA, 22 bp, Homo sapiens
cattattgttccttagaaccat

SEQ ID NO: 561456 - DNA, 22 bp, Homo sapiens
tgggtatatagtggctttccat

SEQ ID NO: 561457 - DNA, 22 bp, Homo sapiens
gccactgtggagctgaggggtt

SEQ ID NO: 561458 - DNA, 22 bp, Homo sapiens
gccagctggggaggggttctgg

SEQ ID NO: 561459 - DNA, 22 bp, Homo sapiens
tcaaatcccagctctgccactt

SEQ ID NO: 561460 - DNA, 22 bp, Homo sapiens
aatgtgttattattgtaattgt

SEQ ID NO: 561461 - DNA, 22 bp, Homo sapiens
ctgctccagccctggggttggg

SEQ ID NO: 561462 - DNA, 22 bp, Homo sapiens
caggcatcaggccggcgccgcg

SEQ ID NO: 561463 - DNA, 22 bp, Homo sapiens
tgctgattacacagaagaacat

SEQ ID NO: 561464 - DNA, 22 bp, Homo sapiens
ggtggatgtgctggcctctatg

SEQ ID NO: 561465 - DNA, 22 bp, Homo sapiens
tgttatcgcatggtaagctttc

SEQ ID NO: 561466 - DNA, 22 bp, Homo sapiens
tcccacagctgttgcagccaac

SEQ ID NO: 561467 - DNA, 22 bp, Homo sapiens
tccccggcgcgccttcccgcgg

SEQ ID NO: 561468 - DNA, 22 bp, Homo sapiens
tgccttctccctgaatgctgtg

SEQ ID NO: 561469 - DNA, 22 bp, Homo sapiens
tggggagagcagggagggggtt

SEQ ID NO: 561470 - DNA, 22 bp, Homo sapiens
gcatagggtggagtgggtgtgc

SEQ ID NO: 561471 - DNA, 22 bp, Homo sapiens
tacatgaaataggattctggag

SEQ ID NO: 561472 - DNA, 22 bp, Homo sapiens
agttaggcccaagaaccagggt

SEQ ID NO: 561473 - DNA, 22 bp, Homo sapiens
gcaatattgttcccccagcctg

SEQ ID NO: 561474 - DNA, 22 bp, Homo sapiens
tactttagataaattatgtgca

SEQ ID NO: 561475 - DNA, 22 bp, Homo sapiens
tcacgagcggagataaatgtca

SEQ ID NO: 561476 - DNA, 22 bp, Homo sapiens
tctttcccaacttactttactc

SEQ ID NO: 561477 - DNA, 22 bp, Homo sapiens
ccattgtttctattaaaggtct

SEQ ID NO: 561478 - DNA, 22 bp, Homo sapiens
caataaatataacaatggatga

SEQ ID NO: 561479 - DNA, 22 bp, Homo sapiens
cattgtaagaaatgggttgcag

SEQ ID NO: 561480 - DNA, 22 bp, Homo sapiens
cgtgtcaatgaggaaccagtag

SEQ ID NO: 561481 - DNA, 22 bp, Homo sapiens
gcctcagttttctcatctgtaa

SEQ ID NO: 561482 - DNA, 22 bp, Homo sapiens
agcacagcacggctgcagaggg

SEQ ID NO: 561483 - DNA, 22 bp, Homo sapiens
aaggaggagttctaagcctttg

SEQ ID NO: 561484 - DNA, 22 bp, Homo sapiens
tcccatcagaccctggggctcg

SEQ ID NO: 561485 - DNA, 22 bp, Homo sapiens
ttgagcggcaccgccagaaacc

SEQ ID NO: 561486 - DNA, 22 bp, Homo sapiens
agacacagctgatgatgtgcat

SEQ ID NO: 561487 - DNA, 22 bp, Homo sapiens
gagacggaggcctgacttaccc

SEQ ID NO: 561488 - DNA, 22 bp, Homo sapiens
caggacccaggggtctggtgac

SEQ ID NO: 561489 - DNA, 22 bp, Homo sapiens
ctgaactgactgtgccctgccc

SEQ ID NO: 561490 - DNA, 22 bp, Homo sapiens
tcactctcctttctcccatctc

SEQ ID NO: 561491 - DNA, 22 bp, Homo sapiens
tcagctgcctctgctatgaccc

SEQ ID NO: 561492 - DNA, 22 bp, Homo sapiens
aaaaagaggattgctattttgg

SEQ ID NO: 561493 - DNA, 22 bp, Homo sapiens
aaacatctagaacagtgcctgg

SEQ ID NO: 561494 - DNA, 22 bp, Homo sapiens
gacaggcattcagtctctgaga

SEQ ID NO: 561495 - DNA, 22 bp, Homo sapiens
tggggcctgggcccaggcagct

SEQ ID NO: 561496 - DNA, 22 bp, Homo sapiens
tctgtcggcagccgccctgggc

SEQ ID NO: 561497 - DNA, 22 bp, Homo sapiens
aagccagcctgagctcctcctc

SEQ ID NO: 561498 - DNA, 22 bp, Homo sapiens
ctccagatcatttggtggggac

SEQ ID NO: 561499 - DNA, 22 bp, Homo sapiens
tgctttcgaaatgaattagcct

SEQ ID NO: 561500 - DNA, 22 bp, Homo sapiens
ccaagatgttggcaggctggga

SEQ ID NO: 561501 - DNA, 22 bp, Homo sapiens
tgtatttgcatgtgtgcacaca

SEQ ID NO: 561502 - DNA, 22 bp, Homo sapiens
tgctccctttgttttagattcc

SEQ ID NO: 561503 - DNA, 22 bp, Homo sapiens
ggtgacagtaggatctacccga

SEQ ID NO: 561504 - DNA, 22 bp, Homo sapiens
tctaggtatgtctgggcaggtt

SEQ ID NO: 561505 - DNA, 22 bp, Homo sapiens
cagccagtagatcgggaggatg

SEQ ID NO: 561506 - DNA, 22 bp, Homo sapiens
aacccagattaggtggcagaag

SEQ ID NO: 561507 - DNA, 22 bp, Homo sapiens
tcttctctattataagctgggt

SEQ ID NO: 561508 - DNA, 22 bp, Homo sapiens
gagcaagcagaagagatggaga

SEQ ID NO: 561509 - DNA, 22 bp, Homo sapiens
ggtttctgtaaatgtgggtcag

SEQ ID NO: 561510 - DNA, 22 bp, Homo sapiens
tcctagtttcagtcccagcttt

SEQ ID NO: 561511 - DNA, 22 bp, Homo sapiens
ggtccgggtccggcccggcttg

SEQ ID NO: 561512 - DNA, 22 bp, Homo sapiens
agtccctgccatggctgctgct

SEQ ID NO: 561513 - DNA, 22 bp, Homo sapiens
tgggggcaggagggagctaaac

SEQ ID NO: 561514 - DNA, 22 bp, Homo sapiens
tggtgattgaataaaagtgtca

SEQ ID NO: 561515 - DNA, 22 bp, Homo sapiens
tggtggctttctagggtcactt

SEQ ID NO: 561516 - DNA, 22 bp, Homo sapiens
aagctgggggagaggaggacca

SEQ ID NO: 561517 - DNA, 22 bp, Homo sapiens
tcctgattggtattgatctgaa

SEQ ID NO: 561518 - DNA, 22 bp, Homo sapiens
tgagttttagatgcctgttaga

SEQ ID NO: 561519 - DNA, 22 bp, Homo sapiens
aggcaggtagctgggctccagg

SEQ ID NO: 561520 - DNA, 22 bp, Homo sapiens
cggcccgcgcgaaccctgggcc

SEQ ID NO: 561521 - DNA, 22 bp, Homo sapiens
ccaggtcctggtgcggacagcc

SEQ ID NO: 561522 - DNA, 22 bp, Homo sapiens
ggaactgtggtcattgcagggt

SEQ ID NO: 561523 - DNA, 22 bp, Homo sapiens
tggtgtggatgggggttggggt

SEQ ID NO: 561524 - DNA, 22 bp, Homo sapiens
cagtcgcccaggctaaaagatt

SEQ ID NO: 561525 - DNA, 22 bp, Homo sapiens
tggagcagttatgatgtcattc

SEQ ID NO: 561526 - DNA, 22 bp, Homo sapiens
cctgcaaccccttcctgacccc

SEQ ID NO: 561527 - DNA, 22 bp, Homo sapiens
ctaaatgataccctaggggcct

SEQ ID NO: 561528 - DNA, 22 bp, Homo sapiens
gatttggaaactagcagacatg

SEQ ID NO: 561529 - DNA, 22 bp, Homo sapiens
taaattgtgcatgtgcatgcag

SEQ ID NO: 561530 - DNA, 22 bp, Homo sapiens
ggagcatacatgaaggatttct

SEQ ID NO: 561531 - DNA, 22 bp, Homo sapiens
tccaggcagcataataaataac

SEQ ID NO: 561532 - DNA, 22 bp, Homo sapiens
tttgttctgcaggtgatgggat

SEQ ID NO: 561533 - DNA, 22 bp, Homo sapiens
gaactgcagtgacagcaggagt

SEQ ID NO: 561534 - DNA, 22 bp, Homo sapiens
atctggggctggggtcgcggcc

SEQ ID NO: 561535 - DNA, 22 bp, Homo sapiens
tgactggatgtttactcaaata

SEQ ID NO: 561536 - DNA, 22 bp, Homo sapiens
gaccaacctgtgttaggctcag

SEQ ID NO: 561537 - DNA, 22 bp, Homo sapiens
tctctgatcaaatgcatgtggt

SEQ ID NO: 561538 - DNA, 22 bp, Homo sapiens
gcctcctgcaagctctgaggct

SEQ ID NO: 561539 - DNA, 22 bp, Homo sapiens
ggacaggctccaggggctgggg

SEQ ID NO: 561540 - DNA, 22 bp, Homo sapiens
tggcacagtagacagtgagcca

SEQ ID NO: 561541 - DNA, 22 bp, Homo sapiens
gcagctaaagagacaatctgat

SEQ ID NO: 561542 - DNA, 22 bp, Homo sapiens
tgggctacagctgcttgtgggt

SEQ ID NO: 561543 - DNA, 22 bp, Homo sapiens
tgccaggagggaaagtaaatgg

SEQ ID NO: 561544 - DNA, 22 bp, Homo sapiens
ggcctgatgtccacctggagtc

SEQ ID NO: 561545 - DNA, 22 bp, Homo sapiens
tcccagccagcccagtggcacc

SEQ ID NO: 561546 - DNA, 22 bp, Homo sapiens
acttcaggatttctgaacttgt

SEQ ID NO: 561547 - DNA, 22 bp, Homo sapiens
catcttcctgtgaagcagtgga

SEQ ID NO: 561548 - DNA, 22 bp, Homo sapiens
cccatggagtacagttgggcaa

SEQ ID NO: 561549 - DNA, 22 bp, Homo sapiens
tctcaaggggtagctgtctcat

SEQ ID NO: 561550 - DNA, 22 bp, Homo sapiens
ctaggttctgttctaatcactg

SEQ ID NO: 561551 - DNA, 22 bp, Homo sapiens
aaaagggaccagggaacatctg

SEQ ID NO: 561552 - DNA, 22 bp, Homo sapiens
tggtgatcaaagactctgaggc

SEQ ID NO: 561553 - DNA, 22 bp, Homo sapiens
ttgcagttgttgctgcttctgc

SEQ ID NO: 561554 - DNA, 22 bp, Homo sapiens
tggtgcttccattgttttaggt

SEQ ID NO: 561555 - DNA, 22 bp, Homo sapiens
tagtcagctcataaattataag

SEQ ID NO: 561556 - DNA, 22 bp, Homo sapiens
tttcactcccctccccactgca

SEQ ID NO: 561557 - DNA, 22 bp, Homo sapiens
actgctaagcagttgccttgat

SEQ ID NO: 561558 - DNA, 22 bp, Homo sapiens
acatttctctgatttgtggcca

SEQ ID NO: 561559 - DNA, 22 bp, Homo sapiens
ggttggaggtcagtggcaaagt

SEQ ID NO: 561560 - DNA, 22 bp, Homo sapiens
tcgctgctccccatgacaggct

SEQ ID NO: 561561 - DNA, 22 bp, Homo sapiens
gactgtttgtacttccagatta

SEQ ID NO: 561562 - DNA, 22 bp, Homo sapiens
tttcttgtgggcagatggggcc

SEQ ID NO: 561563 - DNA, 22 bp, Homo sapiens
gcttttgactgggtgtctaagg

SEQ ID NO: 561564 - DNA, 22 bp, Homo sapiens
tagttatcatagcttcacttaa

SEQ ID NO: 561565 - DNA, 22 bp, Homo sapiens
agctcccccagtgccttctgct

SEQ ID NO: 561566 - DNA, 22 bp, Homo sapiens
tgatcatgtcgggcaagagtag

SEQ ID NO: 561567 - DNA, 22 bp, Homo sapiens
tctgtgcagaatgatcctttcc

SEQ ID NO: 561568 - DNA, 22 bp, Homo sapiens
caaatcagactcctccaatcct

SEQ ID NO: 561569 - DNA, 22 bp, Homo sapiens
aagggggatttgtgcttgtaac

SEQ ID NO: 561570 - DNA, 22 bp, Homo sapiens
ttgactgttttcttacatagta

SEQ ID NO: 561571 - DNA, 22 bp, Homo sapiens
ctgggcactcagtaagtatctg

SEQ ID NO: 561572 - DNA, 22 bp, Homo sapiens
agaccagcaaggcctggcctca

SEQ ID NO: 561573 - DNA, 22 bp, Homo sapiens
gatgagctcattgtaatatgag

SEQ ID NO: 561574 - DNA, 22 bp, Homo sapiens
aaggggagcagggaggaaggag

SEQ ID NO: 561575 - DNA, 22 bp, Homo sapiens
tcctcctctgctaagccgcctg

SEQ ID NO: 561576 - DNA, 22 bp, Homo sapiens
tgggtgagcactttcatgcact

SEQ ID NO: 561577 - DNA, 22 bp, Homo sapiens
tggagagctgagacctctgatg

SEQ ID NO: 561578 - DNA, 22 bp, Homo sapiens
tgactgcagcccctggtgtggt

SEQ ID NO: 561579 - DNA, 22 bp, Homo sapiens
ttaaatattagatttcattact

SEQ ID NO: 561580 - DNA, 22 bp, Homo sapiens
gactaatttcagagttaaagag

SEQ ID NO: 561581 - DNA, 22 bp, Homo sapiens
gcattactagtgcgccagccta

SEQ ID NO: 561582 - DNA, 22 bp, Homo sapiens
cttgcgacatctaagcccgctg

SEQ ID NO: 561583 - DNA, 22 bp, Homo sapiens
tgtgaagtgctgggtggcggct

SEQ ID NO: 561584 - DNA, 22 bp, Homo sapiens
tcccacctggaagctgtgaggc

SEQ ID NO: 561585 - DNA, 22 bp, Homo sapiens
cctgcctgccccgccctggcag

SEQ ID NO: 561586 - DNA, 22 bp, Homo sapiens
tgatggagtttttaaaacctgc

SEQ ID NO: 561587 - DNA, 22 bp, Homo sapiens
tgcacatgtgtatgcatgcatg

SEQ ID NO: 561588 - DNA, 22 bp, Homo sapiens
ccagcttcaccaagcccgtgct

SEQ ID NO: 561589 - DNA, 22 bp, Homo sapiens
aggacaccaaactaattgggat

SEQ ID NO: 561590 - DNA, 22 bp, Homo sapiens
tcccttctttttgcagaggagg

SEQ ID NO: 561591 - DNA, 22 bp, Homo sapiens
tccctgtgtcttctgtgcaagg

SEQ ID NO: 561592 - DNA, 22 bp, Homo sapiens
agacaagaaagtagatacacgc

SEQ ID NO: 561593 - DNA, 22 bp, Homo sapiens
agaggcctgaagaagtcatagc

SEQ ID NO: 561594 - DNA, 22 bp, Homo sapiens
gggattcctcaccctcagggca

SEQ ID NO: 561595 - DNA, 22 bp, Homo sapiens
tagggaggaagcttgttttgct

SEQ ID NO: 561596 - DNA, 22 bp, Homo sapiens
gcatgggactttagtccagatt

SEQ ID NO: 561597 - DNA, 22 bp, Homo sapiens
gagcagggaccaggcgctgtga

SEQ ID NO: 561598 - DNA, 22 bp, Homo sapiens
ggaagagactttttcctttttg

SEQ ID NO: 561599 - DNA, 22 bp, Homo sapiens
gcaggcatcccttttagttcat

SEQ ID NO: 561600 - DNA, 22 bp, Homo sapiens
tggagcctccgggtgtggccat

SEQ ID NO: 561601 - DNA, 22 bp, Homo sapiens
tttgctccagaatgttcttttc

SEQ ID NO: 561602 - DNA, 22 bp, Homo sapiens
tgggaacagttttgtttgaaag

SEQ ID NO: 561603 - DNA, 22 bp, Homo sapiens
tgcttgaatagttttggatagc

SEQ ID NO: 561604 - DNA, 22 bp, Homo sapiens
acccaggcaattttctgttgca

SEQ ID NO: 561605 - DNA, 22 bp, Homo sapiens
gactactgaagaagcatgctgt

SEQ ID NO: 561606 - DNA, 22 bp, Homo sapiens
tagacatcctctcaattgcttt

SEQ ID NO: 561607 - DNA, 22 bp, Homo sapiens
acaaggtcctttgggtacttca

SEQ ID NO: 561608 - DNA, 22 bp, Homo sapiens
tgagtaggaagaccagaaagaa

SEQ ID NO: 561609 - DNA, 22 bp, Homo sapiens
ttggcctagttggagcccccgg

SEQ ID NO: 561610 - DNA, 22 bp, Homo sapiens
ggcactatttcacaattgagat

SEQ ID NO: 561611 - DNA, 22 bp, Homo sapiens
tcaaagagttgctaaaggcttt

SEQ ID NO: 561612 - DNA, 22 bp, Homo sapiens
tcttttctgattccagtgggac

SEQ ID NO: 561613 - DNA, 22 bp, Homo sapiens
tgttcctttcccttttgcatgt

SEQ ID NO: 561614 - DNA, 22 bp, Homo sapiens
ggcccaccttccccggtgtaca

SEQ ID NO: 561615 - DNA, 22 bp, Homo sapiens
catactttgagaaagtgtttag

SEQ ID NO: 561616 - DNA, 22 bp, Homo sapiens
tgatgtgcatggaggctttcat

SEQ ID NO: 561617 - DNA, 22 bp, Homo sapiens
gcagctttaataaacagctcca

SEQ ID NO: 561618 - DNA, 22 bp, Homo sapiens
tgctgttctctagaaatccagc

SEQ ID NO: 561619 - DNA, 22 bp, Homo sapiens
ggaggggtggggaagcaactgc

SEQ ID NO: 561620 - DNA, 22 bp, Homo sapiens
tgattgaagttttgctagcagg

SEQ ID NO: 561621 - DNA, 22 bp, Homo sapiens
agccccctcctctcctcctctg

SEQ ID NO: 561622 - DNA, 22 bp, Homo sapiens
ctgcttttaacataaccagatg

SEQ ID NO: 561623 - DNA, 22 bp, Homo sapiens
agtgagatctcacaaattgtat

SEQ ID NO: 561624 - DNA, 22 bp, Homo sapiens
ctcacagggtatgtagggaaca

SEQ ID NO: 561625 - DNA, 22 bp, Homo sapiens
gtagtggctaagagcctgggcc

SEQ ID NO: 561626 - DNA, 22 bp, Homo sapiens
aggtggctgcacactgggccga

SEQ ID NO: 561627 - DNA, 22 bp, Homo sapiens
gtccaggctccgggatgtcgtg

SEQ ID NO: 561628 - DNA, 22 bp, Homo sapiens
ttaaagtcaccatttgtgggtt

SEQ ID NO: 561629 - DNA, 22 bp, Homo sapiens
tcccacagagaagacaggcaag

SEQ ID NO: 561630 - DNA, 22 bp, Homo sapiens
tcctaatgattttctatgtctg

SEQ ID NO: 561631 - DNA, 22 bp, Homo sapiens
tctgagcccagagctggtggtg

SEQ ID NO: 561632 - DNA, 22 bp, Homo sapiens
catatagtaggtgctctgtgtt

SEQ ID NO: 561633 - DNA, 22 bp, Homo sapiens
cagggatcatcttgtcagttat

SEQ ID NO: 561634 - DNA, 22 bp, Homo sapiens
tatttacatcttgaggtatggg

SEQ ID NO: 561635 - DNA, 22 bp, Homo sapiens
tggcggccaggagaagacatat

SEQ ID NO: 561636 - DNA, 22 bp, Homo sapiens
tgctccctcagggtcccgctct

SEQ ID NO: 561637 - DNA, 22 bp, Homo sapiens
acacttgggcaagcaatggctc

SEQ ID NO: 561638 - DNA, 22 bp, Homo sapiens
gccctgaccacagacaaagcag

SEQ ID NO: 561639 - DNA, 22 bp, Homo sapiens
cctctgcgtgtgaaggtgccag

SEQ ID NO: 561640 - DNA, 22 bp, Homo sapiens
aagtatagcattctaacagcat

SEQ ID NO: 561641 - DNA, 22 bp, Homo sapiens
ttcttctgtgatattgggagtg

SEQ ID NO: 561642 - DNA, 22 bp, Homo sapiens
tgtgtgtgggtggggagatggg

SEQ ID NO: 561643 - DNA, 22 bp, Homo sapiens
tgactcattagcagtctgtaaa

SEQ ID NO: 561644 - DNA, 22 bp, Homo sapiens
tcggctaacatgcaactgctgt

SEQ ID NO: 561645 - DNA, 22 bp, Homo sapiens
gattacttatatacagaatgtt

SEQ ID NO: 561646 - DNA, 22 bp, Homo sapiens
ttgctgtggaccttgagtaagg

SEQ ID NO: 561647 - DNA, 22 bp, Homo sapiens
tgagcctggcatatcccaggca

SEQ ID NO: 561648 - DNA, 22 bp, Homo sapiens
tggcctgtctctcctctgtcct

SEQ ID NO: 561649 - DNA, 22 bp, Homo sapiens
tctgtgcattacacttttctca

SEQ ID NO: 561650 - DNA, 22 bp, Homo sapiens
ttgagcctctttggtagataat

SEQ ID NO: 561651 - DNA, 22 bp, Homo sapiens
gaggaggcagaaatggtagctg

SEQ ID NO: 561652 - DNA, 22 bp, Homo sapiens
tggtaaattgttggaactggag

SEQ ID NO: 561653 - DNA, 22 bp, Homo sapiens
cggggcctggtgaattaggacg

SEQ ID NO: 561654 - DNA, 22 bp, Homo sapiens
tcttcccactatctgctcatca

SEQ ID NO: 561655 - DNA, 22 bp, Homo sapiens
tctatgccaactattgtcccct

SEQ ID NO: 561656 - DNA, 22 bp, Homo sapiens
taaacatgcagcctgccaattc

SEQ ID NO: 561657 - DNA, 22 bp, Homo sapiens
ggctttgtgccccgggtgcccc

SEQ ID NO: 561658 - DNA, 22 bp, Homo sapiens
tagtgggcaagaggaagagaag

SEQ ID NO: 561659 - DNA, 22 bp, Homo sapiens
agggaggtaatggaatcatctg

SEQ ID NO: 561660 - DNA, 22 bp, Homo sapiens
tcagggctttgggcctggcttt

SEQ ID NO: 561661 - DNA, 22 bp, Homo sapiens
tgctgcctcctccctctgccca

SEQ ID NO: 561662 - DNA, 22 bp, Homo sapiens
cgggggctggggctgcaggatg

SEQ ID NO: 561663 - DNA, 22 bp, Homo sapiens
ttacttcttcagggcttccatt

SEQ ID NO: 561664 - DNA, 22 bp, Homo sapiens
tagggtagatttaagtcgatgt

SEQ ID NO: 561665 - DNA, 22 bp, Homo sapiens
gtatgagcttgtgggcctccag

SEQ ID NO: 561666 - DNA, 22 bp, Homo sapiens
ccactgggtgtttggtgggcac

SEQ ID NO: 561667 - DNA, 22 bp, Homo sapiens
tggggagtctatggggaaaatt

SEQ ID NO: 561668 - DNA, 22 bp, Homo sapiens
cttttaatttagatttaaagaa

SEQ ID NO: 561669 - DNA, 22 bp, Homo sapiens
ggctgggtaatgaaggcacact

SEQ ID NO: 561670 - DNA, 22 bp, Homo sapiens
caacaagtctggggagaaaagg

SEQ ID NO: 561671 - DNA, 22 bp, Homo sapiens
tagttatgttggcccctggttc

SEQ ID NO: 561672 - DNA, 22 bp, Homo sapiens
cacttcctttcctcctaccggt

SEQ ID NO: 561673 - DNA, 22 bp, Homo sapiens
tggaaatagtaatgcataagtg

SEQ ID NO: 561674 - DNA, 22 bp, Homo sapiens
taagagaattaatgtttgggtg

SEQ ID NO: 561675 - DNA, 22 bp, Homo sapiens
aggttttcatgcctgataatgg

SEQ ID NO: 561676 - DNA, 22 bp, Homo sapiens
agaaaagcaacgttgaagatgc

SEQ ID NO: 561677 - DNA, 22 bp, Homo sapiens
acttctgatgttatcctcgctc

SEQ ID NO: 561678 - DNA, 22 bp, Homo sapiens
caaatctatatgtccggtccaa

SEQ ID NO: 561679 - DNA, 22 bp, Homo sapiens
tgtactggaactcgagtgaaca

SEQ ID NO: 561680 - DNA, 22 bp, Homo sapiens
tctttcccagccctgtacctgg

SEQ ID NO: 561681 - DNA, 22 bp, Homo sapiens
tgtggggtgggaggtgagggga

SEQ ID NO: 561682 - DNA, 22 bp, Homo sapiens
ttactgtgataataatatgagt

SEQ ID NO: 561683 - DNA, 22 bp, Homo sapiens
tcctaccttttctcatcatttt

SEQ ID NO: 561684 - DNA, 22 bp, Homo sapiens
tgggtttaagaggtttatgaat

SEQ ID NO: 561685 - DNA, 22 bp, Homo sapiens
ttctgacatggtagacttttgg

SEQ ID NO: 561686 - DNA, 22 bp, Homo sapiens
ttcagtcgctcatcagacctct

SEQ ID NO: 561687 - DNA, 22 bp, Homo sapiens
tgtaactgctcataggaaacca

SEQ ID NO: 561688 - DNA, 22 bp, Homo sapiens
tatcttgctaaatattttggct

SEQ ID NO: 561689 - DNA, 22 bp, Homo sapiens
caagagtaagaagggaaaggaa

SEQ ID NO: 561690 - DNA, 22 bp, Homo sapiens
tggcacagaattattgattggc

SEQ ID NO: 561691 - DNA, 22 bp, Homo sapiens
ggctgccaggcatatggcctct

SEQ ID NO: 561692 - DNA, 22 bp, Homo sapiens
tttgtggaaatcctgggtgaca

SEQ ID NO: 561693 - DNA, 22 bp, Homo sapiens
tcaaagggtagcccagggaaga

SEQ ID NO: 561694 - DNA, 22 bp, Homo sapiens
ttgtggcggcctctgacatcac

SEQ ID NO: 561695 - DNA, 22 bp, Homo sapiens
tgtccataatagcatagagtga

SEQ ID NO: 561696 - DNA, 22 bp, Homo sapiens
ccctgccttctccattcacaca

SEQ ID NO: 561697 - DNA, 22 bp, Homo sapiens
tccatcactgtctttcttgggc

SEQ ID NO: 561698 - DNA, 22 bp, Homo sapiens
aaactctagaagatgtggtctg

SEQ ID NO: 561699 - DNA, 22 bp, Homo sapiens
tgcagggagcaattgtgaacat

SEQ ID NO: 561700 - DNA, 22 bp, Homo sapiens
caggggtcaggcaggaggctca

SEQ ID NO: 561701 - DNA, 22 bp, Homo sapiens
tttcagagtgtttaaacacaat

SEQ ID NO: 561702 - DNA, 22 bp, Homo sapiens
aagaggaacttaggagctaaat

SEQ ID NO: 561703 - DNA, 22 bp, Homo sapiens
agtagaggcagtttcccctggg

SEQ ID NO: 561704 - DNA, 22 bp, Homo sapiens
aggcataatgtcaaagtaaaaa

SEQ ID NO: 561705 - DNA, 22 bp, Homo sapiens
gtttggtgtcaccatcaaccct

SEQ ID NO: 561706 - DNA, 22 bp, Homo sapiens
catttgcctgcagagattttcc

SEQ ID NO: 561707 - DNA, 22 bp, Homo sapiens
tggggcaggatggtgagaggag

SEQ ID NO: 561708 - DNA, 22 bp, Homo sapiens
tcctagctcacacctacctaga

SEQ ID NO: 561709 - DNA, 22 bp, Homo sapiens
gagggtgtggaggttcagggca

SEQ ID NO: 561710 - DNA, 22 bp, Homo sapiens
tgccagaggctgttgccagagg

SEQ ID NO: 561711 - DNA, 22 bp, Homo sapiens
aaatatgcctataggaatcaaa

SEQ ID NO: 561712 - DNA, 22 bp, Homo sapiens
ggtgcgtgtcagggtcctgggg

SEQ ID NO: 561713 - DNA, 22 bp, Homo sapiens
gcgcggggcgctctgcagaccc

SEQ ID NO: 561714 - DNA, 22 bp, Homo sapiens
tctccagctttaacatggggcc

SEQ ID NO: 561715 - DNA, 22 bp, Homo sapiens
aatattcatctatttatttgat

SEQ ID NO: 561716 - DNA, 22 bp, Homo sapiens
tgggtttactaggtccttctga

SEQ ID NO: 561717 - DNA, 22 bp, Homo sapiens
tcctaactgccctatgctgcat

SEQ ID NO: 561718 - DNA, 22 bp, Homo sapiens
tgcagttcgccaggcgcgttcc

SEQ ID NO: 561719 - DNA, 22 bp, Homo sapiens
aggtgagtaggtcgcatggaaa

SEQ ID NO: 561720 - DNA, 22 bp, Homo sapiens
ctgatgaatctgaactgagagg

SEQ ID NO: 561721 - DNA, 22 bp, Homo sapiens
tgagcagtctgggggactcttg

SEQ ID NO: 561722 - DNA, 22 bp, Homo sapiens
gctgttaatcagggaaatgcca

SEQ ID NO: 561723 - DNA, 22 bp, Homo sapiens
tggtggccgcgggagagccagc

SEQ ID NO: 561724 - DNA, 22 bp, Homo sapiens
agcttaaatttctgtttttttt

SEQ ID NO: 561725 - DNA, 22 bp, Homo sapiens
gggccaggccagactggggagg

SEQ ID NO: 561726 - DNA, 22 bp, Homo sapiens
ttttcagtgggtgcagatttat

SEQ ID NO: 561727 - DNA, 22 bp, Homo sapiens
cccacatttttgagtcttcatc

SEQ ID NO: 561728 - DNA, 22 bp, Homo sapiens
aagaaggagcggcccttgtgac

SEQ ID NO: 561729 - DNA, 22 bp, Homo sapiens
ttggtggctgcagaggttttcc

SEQ ID NO: 561730 - DNA, 22 bp, Homo sapiens
tctggcccctgttgtctgcatg

SEQ ID NO: 561731 - DNA, 22 bp, Homo sapiens
gatttttctgtgctggagcact

SEQ ID NO: 561732 - DNA, 22 bp, Homo sapiens
ttcacggaaaattgaaggcttg

SEQ ID NO: 561733 - DNA, 22 bp, Homo sapiens
tgctgtgagttacctttggtta

SEQ ID NO: 561734 - DNA, 22 bp, Homo sapiens
gtggttatccctgctgtgttcg

SEQ ID NO: 561735 - DNA, 22 bp, Homo sapiens
tcctaactaacatgatttgcta

SEQ ID NO: 561736 - DNA, 22 bp, Homo sapiens
cgggcgggtgggtggttcaaat

SEQ ID NO: 561737 - DNA, 22 bp, Homo sapiens
cccacggcttcagccctgctca

SEQ ID NO: 561738 - DNA, 22 bp, Homo sapiens
cgtagaatgaaatgctttttca

SEQ ID NO: 561739 - DNA, 22 bp, Homo sapiens
tcaggcacagttgatgagtgtt

SEQ ID NO: 561740 - DNA, 22 bp, Homo sapiens
attgcatagcttgtctcctagt

SEQ ID NO: 561741 - DNA, 22 bp, Homo sapiens
cttctgggctgggctggggcct

SEQ ID NO: 561742 - DNA, 22 bp, Homo sapiens
tactgacctcatccttgaaacc

SEQ ID NO: 561743 - DNA, 22 bp, Homo sapiens
tactaagcaacaggagcctgtt

SEQ ID NO: 561744 - DNA, 22 bp, Homo sapiens
tctcaggaatcctcccagggaa

SEQ ID NO: 561745 - DNA, 22 bp, Homo sapiens
gtcactggggtcagagccagct

SEQ ID NO: 561746 - DNA, 22 bp, Homo sapiens
tagatagctagagccagatttc

SEQ ID NO: 561747 - DNA, 22 bp, Homo sapiens
cacccctcctgtgttccagctc

SEQ ID NO: 561748 - DNA, 22 bp, Homo sapiens
taagagttgaggttgaactggg

SEQ ID NO: 561749 - DNA, 22 bp, Homo sapiens
tgggaccgggggccagggaggg

SEQ ID NO: 561750 - DNA, 22 bp, Homo sapiens
tagaaggggaggggaggtcttc

SEQ ID NO: 561751 - DNA, 22 bp, Homo sapiens
taggactgtgtgcctgcacata

SEQ ID NO: 561752 - DNA, 22 bp, Homo sapiens
agaccagcagtgaaggagacat

SEQ ID NO: 561753 - DNA, 22 bp, Homo sapiens
tatatattaatgagactcagta

SEQ ID NO: 561754 - DNA, 22 bp, Homo sapiens
tcacttttatagataggtctgg

SEQ ID NO: 561755 - DNA, 22 bp, Homo sapiens
taaaacccagatttgccctgct

SEQ ID NO: 561756 - DNA, 22 bp, Homo sapiens
ctggtccaggcctggagctcag

SEQ ID NO: 561757 - DNA, 22 bp, Homo sapiens
gcagccttttctcagagcggcc

SEQ ID NO: 561758 - DNA, 22 bp, Homo sapiens
tgccttggctggcgccgggcta

SEQ ID NO: 561759 - DNA, 22 bp, Homo sapiens
tttctctttctttccccagact

SEQ ID NO: 561760 - DNA, 22 bp, Homo sapiens
gtcgctccctccagctgcagga

SEQ ID NO: 561761 - DNA, 22 bp, Homo sapiens
tttggtgatagattaaaaaggg

SEQ ID NO: 561762 - DNA, 22 bp, Homo sapiens
tgggagggaggggccagggata

SEQ ID NO: 561763 - DNA, 22 bp, Homo sapiens
ttggatgctttgggaatgggtg

SEQ ID NO: 561764 - DNA, 22 bp, Homo sapiens
gtccccagtgtcactgctacct

SEQ ID NO: 561765 - DNA, 22 bp, Homo sapiens
atggtgcccactcacaagttgg

SEQ ID NO: 561766 - DNA, 22 bp, Homo sapiens
cagccttattagtcctgcctga

SEQ ID NO: 561767 - DNA, 22 bp, Homo sapiens
gcttttgaggatacttcatttg

SEQ ID NO: 561768 - DNA, 22 bp, Homo sapiens
agtggttggagattcatctgtg

SEQ ID NO: 561769 - DNA, 22 bp, Homo sapiens
tctccccagcagtctttgggcc

SEQ ID NO: 561770 - DNA, 22 bp, Homo sapiens
tgtggttagaaattaggagaat

SEQ ID NO: 561771 - DNA, 22 bp, Homo sapiens
aaatgggaatgtataaagtact

SEQ ID NO: 561772 - DNA, 22 bp, Homo sapiens
tcttggctggggtagagataac

SEQ ID NO: 561773 - DNA, 22 bp, Homo sapiens
tgtgtgtgtgtgtgcaatgggt

SEQ ID NO: 561774 - DNA, 22 bp, Homo sapiens
caggcagcacttcctttctgtg

SEQ ID NO: 561775 - DNA, 22 bp, Homo sapiens
taaacaacagagaatcagtaaa

SEQ ID NO: 561776 - DNA, 22 bp, Homo sapiens
tgtggtttctgcgctggttatc

SEQ ID NO: 561777 - DNA, 22 bp, Homo sapiens
tccaaggaagtcccttatggcc

SEQ ID NO: 561778 - DNA, 22 bp, Homo sapiens
tgtgtgttccagaggagtcctg

SEQ ID NO: 561779 - DNA, 22 bp, Homo sapiens
ctgcccagcccccaacccagag

SEQ ID NO: 561780 - DNA, 22 bp, Homo sapiens
gggaaaatacctgctacaagat

SEQ ID NO: 561781 - DNA, 22 bp, Homo sapiens
ccttgccggtgctgccacgtga

SEQ ID NO: 561782 - DNA, 22 bp, Homo sapiens
cttcatgctgctgtcccttttc

SEQ ID NO: 561783 - DNA, 22 bp, Homo sapiens
tggcaggggctccgtcttggct

SEQ ID NO: 561784 - DNA, 22 bp, Homo sapiens
aggaagagaggttggggccagt

SEQ ID NO: 561785 - DNA, 22 bp, Homo sapiens
catgctgccacctgtggtagtc

SEQ ID NO: 561786 - DNA, 22 bp, Homo sapiens
gacgccctctgccccgcaggag

SEQ ID NO: 561787 - DNA, 22 bp, Homo sapiens
accattgttcaaaagatcgcgt

SEQ ID NO: 561788 - DNA, 22 bp, Homo sapiens
tggagcagtgagtcttttacac

SEQ ID NO: 561789 - DNA, 22 bp, Homo sapiens
gatatggggagaggagtgaaca

SEQ ID NO: 561790 - DNA, 22 bp, Homo sapiens
tctttaaactagacttaaggtc

SEQ ID NO: 561791 - DNA, 22 bp, Homo sapiens
tttgttgctttggatgaagata

SEQ ID NO: 561792 - DNA, 22 bp, Homo sapiens
attggctgatgaggaaggttgg

SEQ ID NO: 561793 - DNA, 22 bp, Homo sapiens
tcacacttcatttcccatcaat

SEQ ID NO: 561794 - DNA, 22 bp, Homo sapiens
agagcctggggaggtgagggga

SEQ ID NO: 561795 - DNA, 22 bp, Homo sapiens
tcccttttctacaaattttaaa

SEQ ID NO: 561796 - DNA, 22 bp, Homo sapiens
tctgcaatggagaaagtgagac

SEQ ID NO: 561797 - DNA, 22 bp, Homo sapiens
accctgaggcccaaccagcagc

SEQ ID NO: 561798 - DNA, 22 bp, Homo sapiens
cctcatggagtctcaggagatg

SEQ ID NO: 561799 - DNA, 22 bp, Homo sapiens
ctctttctggtctcttccctcc

SEQ ID NO: 561800 - DNA, 22 bp, Homo sapiens
tcaacactttaaaaatctttct

SEQ ID NO: 561801 - DNA, 22 bp, Homo sapiens
tggcagcaggagaaggtgccct

SEQ ID NO: 561802 - DNA, 22 bp, Homo sapiens
ggaatgaggccgtggccctgca

SEQ ID NO: 561803 - DNA, 22 bp, Homo sapiens
tgagtatcttgaattcatctct

SEQ ID NO: 561804 - DNA, 22 bp, Homo sapiens
ttccagtttggtgcaataaatt

SEQ ID NO: 561805 - DNA, 22 bp, Homo sapiens
aatatgggtttactagttggtg

SEQ ID NO: 561806 - DNA, 22 bp, Homo sapiens
taggatgccatttaagatctgt

SEQ ID NO: 561807 - DNA, 22 bp, Homo sapiens
tcatcaacttttccagctagtc

SEQ ID NO: 561808 - DNA, 22 bp, Homo sapiens
tctggtgcggagagggcccaca

SEQ ID NO: 561809 - DNA, 22 bp, Homo sapiens
tctcgggttcactcctttcctg

SEQ ID NO: 561810 - DNA, 22 bp, Homo sapiens
tggtagccaatgatatgccatt

SEQ ID NO: 561811 - DNA, 22 bp, Homo sapiens
caacttggggtggtacaaggag

SEQ ID NO: 561812 - DNA, 22 bp, Homo sapiens
ttgggcttgtggtcacctcaca

SEQ ID NO: 561813 - DNA, 22 bp, Homo sapiens
agggagggagagaaagactgca

SEQ ID NO: 561814 - DNA, 22 bp, Homo sapiens
ttctgtgcagggacctttgctg

SEQ ID NO: 561815 - DNA, 22 bp, Homo sapiens
tttcacctttgcccagctgttg

SEQ ID NO: 561816 - DNA, 22 bp, Homo sapiens
tgttgttgacctgctgggtgtg

SEQ ID NO: 561817 - DNA, 22 bp, Homo sapiens
atttcagtccccgggtgtctcc

SEQ ID NO: 561818 - DNA, 22 bp, Homo sapiens
cattcaaagcaatgccaggctt

SEQ ID NO: 561819 - DNA, 22 bp, Homo sapiens
ctgaagtgttaccagcatggag

SEQ ID NO: 561820 - DNA, 22 bp, Homo sapiens
aatcccagagataaagcacaga

SEQ ID NO: 561821 - DNA, 22 bp, Homo sapiens
tagtgattttcatattacatta

SEQ ID NO: 561822 - DNA, 22 bp, Homo sapiens
tccctgagtgtatgtggtgaac

SEQ ID NO: 561823 - DNA, 22 bp, Homo sapiens
acagggcaaggggcccagcagg

SEQ ID NO: 561824 - DNA, 22 bp, Homo sapiens
ttccctctcggtgggagtcaag

SEQ ID NO: 561825 - DNA, 22 bp, Homo sapiens
agtggagagagccacagccagg

SEQ ID NO: 561826 - DNA, 22 bp, Homo sapiens
ttaggctgtcagcggctgccga

SEQ ID NO: 561827 - DNA, 22 bp, Homo sapiens
tatttttgatccagacctcctt

SEQ ID NO: 561828 - DNA, 22 bp, Homo sapiens
aggtcaagaactatgacaccac

SEQ ID NO: 561829 - DNA, 22 bp, Homo sapiens
taaagactagacttcgctatga

SEQ ID NO: 561830 - DNA, 22 bp, Homo sapiens
tatgtggttttgaatcggatgt

SEQ ID NO: 561831 - DNA, 22 bp, Homo sapiens
gaggtagggaaatctcttgctc

SEQ ID NO: 561832 - DNA, 22 bp, Homo sapiens
aaagccttcccctttgcatatg

SEQ ID NO: 561833 - DNA, 22 bp, Homo sapiens
gaagacaaacttctcctaatcc

SEQ ID NO: 561834 - DNA, 22 bp, Homo sapiens
tttcctatgcatatacttcttt

SEQ ID NO: 561835 - DNA, 22 bp, Homo sapiens
ttagtttttttccatacccctg

SEQ ID NO: 561836 - DNA, 22 bp, Homo sapiens
tcaaaatgtggaaaggagaaag

SEQ ID NO: 561837 - DNA, 22 bp, Homo sapiens
tactttttcatgatgattaatc

SEQ ID NO: 561838 - DNA, 22 bp, Homo sapiens
tccaggtgatacattcagtggc

SEQ ID NO: 561839 - DNA, 22 bp, Homo sapiens
tcaggggaaatcctcagagtca

SEQ ID NO: 561840 - DNA, 22 bp, Homo sapiens
tctgaggagctctgttcactct

SEQ ID NO: 561841 - DNA, 22 bp, Homo sapiens
tggcagctcattgaatccaatt

SEQ ID NO: 561842 - DNA, 22 bp, Homo sapiens
agcagatgttggtccctttaga

SEQ ID NO: 561843 - DNA, 22 bp, Homo sapiens
tgcatgtctgtttcttctcaat

SEQ ID NO: 561844 - DNA, 22 bp, Homo sapiens
cagtcccctccccagccccgac

SEQ ID NO: 561845 - DNA, 22 bp, Homo sapiens
agaagcagctttcaaggtgatt

SEQ ID NO: 561846 - DNA, 22 bp, Homo sapiens
gtctttctcctggggctgtgca

SEQ ID NO: 561847 - DNA, 22 bp, Homo sapiens
atgggagcggggtgggggcagc

SEQ ID NO: 561848 - DNA, 22 bp, Homo sapiens
tggcagttgaaggagctttgaa

SEQ ID NO: 561849 - DNA, 22 bp, Homo sapiens
tcgtgcctctccttttcattta

SEQ ID NO: 561850 - DNA, 22 bp, Homo sapiens
ttgggctccagtcctaaggaaa

SEQ ID NO: 561851 - DNA, 22 bp, Homo sapiens
gaaagtggtgggggacacccca

SEQ ID NO: 561852 - DNA, 22 bp, Homo sapiens
tcatccttattaattattgtta

SEQ ID NO: 561853 - DNA, 22 bp, Homo sapiens
tatgggtaccacctcactgaat

SEQ ID NO: 561854 - DNA, 22 bp, Homo sapiens
tgaagcatgcttatatgtcttg

SEQ ID NO: 561855 - DNA, 22 bp, Homo sapiens
tggcagcacagtatattttgga

SEQ ID NO: 561856 - DNA, 22 bp, Homo sapiens
ttatgaataagctcatttctga

SEQ ID NO: 561857 - DNA, 22 bp, Homo sapiens
tcgtttcctcgctcgcctttcc

SEQ ID NO: 561858 - DNA, 22 bp, Homo sapiens
agagagccctgaacgtggccct

SEQ ID NO: 561859 - DNA, 22 bp, Homo sapiens
tagcggtattaggaatgagggc

SEQ ID NO: 561860 - DNA, 22 bp, Homo sapiens
tcagggacccctctgagtggag

SEQ ID NO: 561861 - DNA, 22 bp, Homo sapiens
gagctccaaacgggctatatgc

SEQ ID NO: 561862 - DNA, 22 bp, Homo sapiens
tccctagctcccatgtctccca

SEQ ID NO: 561863 - DNA, 22 bp, Homo sapiens
tacaatggcatctatctataat

SEQ ID NO: 561864 - DNA, 22 bp, Homo sapiens
agcgcctgccccggtgggtggg

SEQ ID NO: 561865 - DNA, 22 bp, Homo sapiens
caaggccagagggcattcaagt

SEQ ID NO: 561866 - DNA, 22 bp, Homo sapiens
tcagaagtcgaaggagggccat

SEQ ID NO: 561867 - DNA, 22 bp, Homo sapiens
tctctcactccagtcagagtca

SEQ ID NO: 561868 - DNA, 22 bp, Homo sapiens
tgagattgaacatcagcaggcg

SEQ ID NO: 561869 - DNA, 22 bp, Homo sapiens
cgggccctggatggcagcgctc

SEQ ID NO: 561870 - DNA, 22 bp, Homo sapiens
tggtctcgatgactgtgcatat

SEQ ID NO: 561871 - DNA, 22 bp, Homo sapiens
gggatccagtgtccttcctttc

SEQ ID NO: 561872 - DNA, 22 bp, Homo sapiens
gaggcagagatgagtaagacag

SEQ ID NO: 561873 - DNA, 22 bp, Homo sapiens
gggagaaatgagccttggtgga

SEQ ID NO: 561874 - DNA, 22 bp, Homo sapiens
ttacatatgtttggcagagttc

SEQ ID NO: 561875 - DNA, 22 bp, Homo sapiens
tgtcctcagcaggacacgacat

SEQ ID NO: 561876 - DNA, 22 bp, Homo sapiens
gtatggggtttggagtagggga

SEQ ID NO: 561877 - DNA, 22 bp, Homo sapiens
gctgacaaaacactaagctctg

SEQ ID NO: 561878 - DNA, 22 bp, Homo sapiens
ggtctgtgtgaaaggataggga

SEQ ID NO: 561879 - DNA, 22 bp, Homo sapiens
tggacacttcatcagcattcac

SEQ ID NO: 561880 - DNA, 22 bp, Homo sapiens
tggttcattaatacagtacatg

SEQ ID NO: 561881 - DNA, 22 bp, Homo sapiens
agtggagtcagcattttatcac

SEQ ID NO: 561882 - DNA, 22 bp, Homo sapiens
ttcagtgaattggaagaggtaa

SEQ ID NO: 561883 - DNA, 22 bp, Homo sapiens
tttcagaagaaaagaccgggat

SEQ ID NO: 561884 - DNA, 22 bp, Homo sapiens
tgagactgggagctgtttctaa

SEQ ID NO: 561885 - DNA, 22 bp, Homo sapiens
tgccggtctgcagagtcctgga

SEQ ID NO: 561886 - DNA, 22 bp, Homo sapiens
ttttagtgtgggctgctttgaa

SEQ ID NO: 561887 - DNA, 22 bp, Homo sapiens
tgctcattgcatgggctgtgta

SEQ ID NO: 561888 - DNA, 22 bp, Homo sapiens
tccctggaggtaattattgacc

SEQ ID NO: 561889 - DNA, 22 bp, Homo sapiens
gcttagctcatgaactgtaggc

SEQ ID NO: 561890 - DNA, 22 bp, Homo sapiens
cccaattgtgcatgtaaagacg

SEQ ID NO: 561891 - DNA, 22 bp, Homo sapiens
tcgttagcagagtcaccgtgtt

SEQ ID NO: 561892 - DNA, 22 bp, Homo sapiens
gaaattcatgggccagatggaa

SEQ ID NO: 561893 - DNA, 22 bp, Homo sapiens
tgctgatacaccccaaaataaa

SEQ ID NO: 561894 - DNA, 22 bp, Homo sapiens
tagtcggcctggggcagttgag

SEQ ID NO: 561895 - DNA, 22 bp, Homo sapiens
ggccacaatgactgccccttgg

SEQ ID NO: 561896 - DNA, 22 bp, Homo sapiens
tctacttctgtgggtgagaatt

SEQ ID NO: 561897 - DNA, 22 bp, Homo sapiens
taggatgaaggaaggttcatca

SEQ ID NO: 561898 - DNA, 22 bp, Homo sapiens
gctaattcatttcgaaagcacc

SEQ ID NO: 561899 - DNA, 22 bp, Homo sapiens
aggtttcaaggctgttggtttg

SEQ ID NO: 561900 - DNA, 22 bp, Homo sapiens
ccagagagagtgactgaggcta

SEQ ID NO: 561901 - DNA, 22 bp, Homo sapiens
taagggaagctatgtggtccag

SEQ ID NO: 561902 - DNA, 22 bp, Homo sapiens
gatacatgagatggttgaccag

SEQ ID NO: 561903 - DNA, 22 bp, Homo sapiens
ggatgcttatttttaaatctca

SEQ ID NO: 561904 - DNA, 22 bp, Homo sapiens
tggggcttctggtgagttgagc

SEQ ID NO: 561905 - DNA, 22 bp, Homo sapiens
tatgcagatgctgccttgttga

SEQ ID NO: 561906 - DNA, 22 bp, Homo sapiens
ctccagctcactcccctctctt

SEQ ID NO: 561907 - DNA, 22 bp, Homo sapiens
tggccaggatgacgtgtaggtg

SEQ ID NO: 561908 - DNA, 22 bp, Homo sapiens
tagtgctacagaacattattct

SEQ ID NO: 561909 - DNA, 22 bp, Homo sapiens
tcattttgtctcctaagctgat

SEQ ID NO: 561910 - DNA, 22 bp, Homo sapiens
caggacccaataggtagagaga

SEQ ID NO: 561911 - DNA, 22 bp, Homo sapiens
aaggattaaagtcaaagcccca

SEQ ID NO: 561912 - DNA, 22 bp, Homo sapiens
ttcagttttcctggaattgagg

SEQ ID NO: 561913 - DNA, 22 bp, Homo sapiens
agtccatgacactgaggcctga

SEQ ID NO: 561914 - DNA, 22 bp, Homo sapiens
ttctacacagataatctgttat

SEQ ID NO: 561915 - DNA, 22 bp, Homo sapiens
ttggctgccatttccatgctcc

SEQ ID NO: 561916 - DNA, 22 bp, Homo sapiens
tgaatacaagctccacgaggga

SEQ ID NO: 561917 - DNA, 22 bp, Homo sapiens
cctgggatttctgctacctgat

SEQ ID NO: 561918 - DNA, 22 bp, Homo sapiens
ttctgggctgtgaaacgctctc

SEQ ID NO: 561919 - DNA, 22 bp, Homo sapiens
tcccttggccccaccctcttca

SEQ ID NO: 561920 - DNA, 22 bp, Homo sapiens
gccagttctactctcagcttct

SEQ ID NO: 561921 - DNA, 22 bp, Homo sapiens
tttgtgattttagggctgtttt

SEQ ID NO: 561922 - DNA, 22 bp, Homo sapiens
cgctggtcattgtagtccagtc

SEQ ID NO: 561923 - DNA, 22 bp, Homo sapiens
tagaatctctttgtgcaaaaat

SEQ ID NO: 561924 - DNA, 22 bp, Homo sapiens
ttcagtagccctgaaaatttct

SEQ ID NO: 561925 - DNA, 22 bp, Homo sapiens
catctattgctctttggtgatg

SEQ ID NO: 561926 - DNA, 22 bp, Homo sapiens
tgattttcatgggaagcaagac

SEQ ID NO: 561927 - DNA, 22 bp, Homo sapiens
tcctcccccaacctcctgccca

SEQ ID NO: 561928 - DNA, 22 bp, Homo sapiens
gctgtgcgtctggagtggagtt

SEQ ID NO: 561929 - DNA, 22 bp, Homo sapiens
tcttaggcagttccagagtttt

SEQ ID NO: 561930 - DNA, 22 bp, Homo sapiens
ccgcccaggctctgcgccgcga

SEQ ID NO: 561931 - DNA, 22 bp, Homo sapiens
tgagagatgtcttaggatggtt

SEQ ID NO: 561932 - DNA, 22 bp, Homo sapiens
tgtcctctagggcctgcagtct

SEQ ID NO: 561933 - DNA, 22 bp, Homo sapiens
aggaaaaggccagggtgcgggg

SEQ ID NO: 561934 - DNA, 22 bp, Homo sapiens
tgtgtcatgtcctgacttgttt

SEQ ID NO: 561935 - DNA, 22 bp, Homo sapiens
tatgaaaagtagtctgaaaaac

SEQ ID NO: 561936 - DNA, 22 bp, Homo sapiens
gcctttgtacataatgcagaac

SEQ ID NO: 561937 - DNA, 22 bp, Homo sapiens
ttctaggcaaaacatagcagaa

SEQ ID NO: 561938 - DNA, 22 bp, Homo sapiens
attgtgaacagataaggaaccc

SEQ ID NO: 561939 - DNA, 22 bp, Homo sapiens
tccccttaccaggctcctcctt

SEQ ID NO: 561940 - DNA, 22 bp, Homo sapiens
tcttcttaagttctggaacagc

SEQ ID NO: 561941 - DNA, 22 bp, Homo sapiens
tctgctattttttagccataag

SEQ ID NO: 561942 - DNA, 22 bp, Homo sapiens
ttcttttattttgagtcaagtt

SEQ ID NO: 561943 - DNA, 22 bp, Homo sapiens
tatttctaccatatgtttaggc

SEQ ID NO: 561944 - DNA, 22 bp, Homo sapiens
ggcaaagtattaatgagtgact

SEQ ID NO: 561945 - DNA, 22 bp, Homo sapiens
ttgtagagacaggacctgagga

SEQ ID NO: 561946 - DNA, 22 bp, Homo sapiens
taggaggtctgagtccatgcag

SEQ ID NO: 561947 - DNA, 22 bp, Homo sapiens
gggctgcagggccctggagtgg

SEQ ID NO: 561948 - DNA, 22 bp, Homo sapiens
gctcaaccttttgccaagaaaa

SEQ ID NO: 561949 - DNA, 22 bp, Homo sapiens
ggagaagtgcataagcaacatt

SEQ ID NO: 561950 - DNA, 22 bp, Homo sapiens
ttagagcatgcctggcacacgg

SEQ ID NO: 561951 - DNA, 22 bp, Homo sapiens
ggtaatgaaccatctctgagcc

SEQ ID NO: 561952 - DNA, 22 bp, Homo sapiens
tgggagttggtggggtgggatg

SEQ ID NO: 561953 - DNA, 22 bp, Homo sapiens
cctttgcagctaaggtcagact

SEQ ID NO: 561954 - DNA, 22 bp, Homo sapiens
tcccatgatggaaggccatgag

SEQ ID NO: 561955 - DNA, 22 bp, Homo sapiens
ttgaccatgtagtcatctgagt

SEQ ID NO: 561956 - DNA, 22 bp, Homo sapiens
gcgcggcgcttcgggccttgta

SEQ ID NO: 561957 - DNA, 22 bp, Homo sapiens
ggctgctgttggttgtaacgtt

SEQ ID NO: 561958 - DNA, 22 bp, Homo sapiens
ttttcttgtatcatactgccta

SEQ ID NO: 561959 - DNA, 22 bp, Homo sapiens
tttgatcatttttggggaagga

SEQ ID NO: 561960 - DNA, 22 bp, Homo sapiens
tatgctgtgactatatgtgtgc

SEQ ID NO: 561961 - DNA, 22 bp, Homo sapiens
tttgcactagggtcagagcctg

SEQ ID NO: 561962 - DNA, 22 bp, Homo sapiens
gcagcaggcgggcattcccaca

SEQ ID NO: 561963 - DNA, 22 bp, Homo sapiens
tcaggtgccagagagtctagac

SEQ ID NO: 561964 - DNA, 22 bp, Homo sapiens
taagtccctgtccctgaccttg

SEQ ID NO: 561965 - DNA, 22 bp, Homo sapiens
gctgtcacctcttctggtttct

SEQ ID NO: 561966 - DNA, 22 bp, Homo sapiens
aggagcagggctgcaggaggag

SEQ ID NO: 561967 - DNA, 22 bp, Homo sapiens
ccccccgccccggtgcattctg

SEQ ID NO: 561968 - DNA, 22 bp, Homo sapiens
ggaaggccagaggaggggaagg

SEQ ID NO: 561969 - DNA, 22 bp, Homo sapiens
gcaaaatcttcgttggaagggc

SEQ ID NO: 561970 - DNA, 22 bp, Homo sapiens
agggggagggtgaagagatggg

SEQ ID NO: 561971 - DNA, 22 bp, Homo sapiens
catttactcagaaaatattttt

SEQ ID NO: 561972 - DNA, 22 bp, Homo sapiens
aggggctgggtagctctgaagg

SEQ ID NO: 561973 - DNA, 22 bp, Homo sapiens
tggtgagcagggaacgtcagtt

SEQ ID NO: 561974 - DNA, 22 bp, Homo sapiens
tctctctggtcctgctgcaact

SEQ ID NO: 561975 - DNA, 22 bp, Homo sapiens
ctgccaccactgccaggtatct

SEQ ID NO: 561976 - DNA, 22 bp, Homo sapiens
taggtaatatatttcctcctct

SEQ ID NO: 561977 - DNA, 22 bp, Homo sapiens
aggttatgaccaactgaggcct

SEQ ID NO: 561978 - DNA, 22 bp, Homo sapiens
tttccatctcctcattgtttct

SEQ ID NO: 561979 - DNA, 22 bp, Homo sapiens
atcatatcttggcttggttcta

SEQ ID NO: 561980 - DNA, 22 bp, Homo sapiens
gattagggtttggattttatcc

SEQ ID NO: 561981 - DNA, 22 bp, Homo sapiens
tgggcacagcggcaacatgata

SEQ ID NO: 561982 - DNA, 22 bp, Homo sapiens
gtgtgagcatggggagcagtga

SEQ ID NO: 561983 - DNA, 22 bp, Homo sapiens
ctccttgagggttgatgctggg

SEQ ID NO: 561984 - DNA, 22 bp, Homo sapiens
tgggttctttttatagtttcaa

SEQ ID NO: 561985 - DNA, 22 bp, Homo sapiens
tacaggtagtaggttgcgtagt

SEQ ID NO: 561986 - DNA, 22 bp, Homo sapiens
ttctctcttgttttctcctccc

SEQ ID NO: 561987 - DNA, 22 bp, Homo sapiens
cttcctcaattccaagtgcatg

SEQ ID NO: 561988 - DNA, 22 bp, Homo sapiens
tggagggggaggggaaagatga

SEQ ID NO: 561989 - DNA, 22 bp, Homo sapiens
ctttattagttcatctgtttta

SEQ ID NO: 561990 - DNA, 22 bp, Homo sapiens
gcctttccaacgaagacttcct

SEQ ID NO: 561991 - DNA, 22 bp, Homo sapiens
gagaataggatggaaaggggtg

SEQ ID NO: 561992 - DNA, 22 bp, Homo sapiens
taatcagacgtgatgaccggac

SEQ ID NO: 561993 - DNA, 22 bp, Homo sapiens
tcagtctgttggaatatcgctg

SEQ ID NO: 561994 - DNA, 22 bp, Homo sapiens
tatccgcctgaatgagtcatgc

SEQ ID NO: 561995 - DNA, 22 bp, Homo sapiens
aagacttcagccttagatgata

SEQ ID NO: 561996 - DNA, 22 bp, Homo sapiens
tcctgatgccagatctgatcga

SEQ ID NO: 561997 - DNA, 22 bp, Homo sapiens
tttcaagctggcctctggcagg

SEQ ID NO: 561998 - DNA, 22 bp, Homo sapiens
tcccagggcgtgcctggttcct

SEQ ID NO: 561999 - DNA, 22 bp, Homo sapiens
tggctttttgtttcaactttca

SEQ ID NO: 562000 - DNA, 22 bp, Homo sapiens
tcagcaatcagtcctcccccag

SEQ ID NO: 562001 - DNA, 22 bp, Homo sapiens
tatttattgattctgggagtgt

SEQ ID NO: 562002 - DNA, 22 bp, Homo sapiens
actcgaggcatatattaatagc

SEQ ID NO: 562003 - DNA, 22 bp, Homo sapiens
aaggcctaggctctgccctccc

SEQ ID NO: 562004 - DNA, 22 bp, Homo sapiens
caggaatggttgcacactgtca

SEQ ID NO: 562005 - DNA, 22 bp, Homo sapiens
tcagctgggactctaaaccaga

SEQ ID NO: 562006 - DNA, 22 bp, Homo sapiens
cttaggccaaatggcgcatcaa

SEQ ID NO: 562007 - DNA, 22 bp, Homo sapiens
cagggtgggcggggggtgaaga

SEQ ID NO: 562008 - DNA, 22 bp, Homo sapiens
ggaccccgggaagtgctcagta

SEQ ID NO: 562009 - DNA, 22 bp, Homo sapiens
tccagtaggatgaactcagaga

SEQ ID NO: 562010 - DNA, 22 bp, Homo sapiens
tctaaatggttaaatgagcata

SEQ ID NO: 562011 - DNA, 22 bp, Homo sapiens
ttctgttggtgacatgataatc

SEQ ID NO: 562012 - DNA, 22 bp, Homo sapiens
ggtgagggagaggctgtgggtg

SEQ ID NO: 562013 - DNA, 22 bp, Homo sapiens
tatttactatcaaaatgcaaat

SEQ ID NO: 562014 - DNA, 22 bp, Homo sapiens
tcttcagatccacactcgtggt

SEQ ID NO: 562015 - DNA, 22 bp, Homo sapiens
ttcgggacatttttagaatcta

SEQ ID NO: 562016 - DNA, 22 bp, Homo sapiens
aacatttattgagcacctggca

SEQ ID NO: 562017 - DNA, 22 bp, Homo sapiens
tgagtgggaggtttgtgtgatg

SEQ ID NO: 562018 - DNA, 22 bp, Homo sapiens
attggctttcaggacttatcta

SEQ ID NO: 562019 - DNA, 22 bp, Homo sapiens
aattggctcgcctttaaggttt

SEQ ID NO: 562020 - DNA, 22 bp, Homo sapiens
gccacaggagacagggccagga

SEQ ID NO: 562021 - DNA, 22 bp, Homo sapiens
gtggaattgaggaagggcagaa

SEQ ID NO: 562022 - DNA, 22 bp, Homo sapiens
tatacatcatttcccatcaatc

SEQ ID NO: 562023 - DNA, 22 bp, Homo sapiens
tccttccatgatgtttggggga

SEQ ID NO: 562024 - DNA, 22 bp, Homo sapiens
tatcaccacagcccttgttctt

SEQ ID NO: 562025 - DNA, 22 bp, Homo sapiens
tgatttcttccacttgggcatg

SEQ ID NO: 562026 - DNA, 22 bp, Homo sapiens
gaggatttggggggctggagag

SEQ ID NO: 562027 - DNA, 22 bp, Homo sapiens
tgttaagcatattacctgcatt

SEQ ID NO: 562028 - DNA, 22 bp, Homo sapiens
attgacacctctgtgagtggag

SEQ ID NO: 562029 - DNA, 22 bp, Homo sapiens
aacatagaaggaatatccacgt

SEQ ID NO: 562030 - DNA, 22 bp, Homo sapiens
ggcagctagagctctttaaagt

SEQ ID NO: 562031 - DNA, 22 bp, Homo sapiens
tggacctgggaactgcttacct

SEQ ID NO: 562032 - DNA, 22 bp, Homo sapiens
tttattgcatcaaatatgtacc

SEQ ID NO: 562033 - DNA, 22 bp, Homo sapiens
tcagctcggacagttgtttcag

SEQ ID NO: 562034 - DNA, 22 bp, Homo sapiens
taagagtagaggagttaaagag

SEQ ID NO: 562035 - DNA, 22 bp, Homo sapiens
aggtgtgcagtaaatatttgtt

SEQ ID NO: 562036 - DNA, 22 bp, Homo sapiens
tagagctctctggtggccatat

SEQ ID NO: 562037 - DNA, 22 bp, Homo sapiens
gacaatttggggtaaattttca

SEQ ID NO: 562038 - DNA, 22 bp, Homo sapiens
acatggattttcctctatgatt

SEQ ID NO: 562039 - DNA, 22 bp, Homo sapiens
gcctccacatggctgaggtgtg

SEQ ID NO: 562040 - DNA, 22 bp, Homo sapiens
agaagcagatgggcaataccga

SEQ ID NO: 562041 - DNA, 22 bp, Homo sapiens
ttggcacagaggcaatcagcct

SEQ ID NO: 562042 - DNA, 22 bp, Homo sapiens
tccgcggctccgagggtgcccg

SEQ ID NO: 562043 - DNA, 22 bp, Homo sapiens
tgtggctcagggagatgagatg

SEQ ID NO: 562044 - DNA, 22 bp, Homo sapiens
aggtggggtggaggctgaggag

SEQ ID NO: 562045 - DNA, 22 bp, Homo sapiens
tccattgtttttaatcgactcc

SEQ ID NO: 562046 - DNA, 22 bp, Homo sapiens
ttgttaactgcacattttatgc

SEQ ID NO: 562047 - DNA, 22 bp, Homo sapiens
tggaaacactgaggttgtgtct

SEQ ID NO: 562048 - DNA, 22 bp, Homo sapiens
tatcgtgtcaatgtgtatttgg

SEQ ID NO: 562049 - DNA, 22 bp, Homo sapiens
gcctccttcctgccgctcttcc

SEQ ID NO: 562050 - DNA, 22 bp, Homo sapiens
tctaaggggcaagcttggtgcc

SEQ ID NO: 562051 - DNA, 22 bp, Homo sapiens
aggtcaggggcatggggtatgg

SEQ ID NO: 562052 - DNA, 22 bp, Homo sapiens
tgagagaagtggggtgagaaga

SEQ ID NO: 562053 - DNA, 22 bp, Homo sapiens
cgccctgctaaggcttggtgta

SEQ ID NO: 562054 - DNA, 22 bp, Homo sapiens
tgtaagggtctgtgtggatgca

SEQ ID NO: 562055 - DNA, 22 bp, Homo sapiens
tttcaactattacctctattag

SEQ ID NO: 562056 - DNA, 22 bp, Homo sapiens
ttttaattgcaattatggtccc

SEQ ID NO: 562057 - DNA, 22 bp, Homo sapiens
actcaagatttctgtctgccga

SEQ ID NO: 562058 - DNA, 22 bp, Homo sapiens
gagtagtagaatgtaagttctg

SEQ ID NO: 562059 - DNA, 22 bp, Homo sapiens
gcatttagcaaaccacaaaagc

SEQ ID NO: 562060 - DNA, 22 bp, Homo sapiens
tgtctgagttccctggagtagc

SEQ ID NO: 562061 - DNA, 22 bp, Homo sapiens
cggaggtgaccctgtgcaggct

SEQ ID NO: 562062 - DNA, 22 bp, Homo sapiens
tcagtgttgcctgctttatggg

SEQ ID NO: 562063 - DNA, 22 bp, Homo sapiens
ggcagtgaaaatcaatgagagc

SEQ ID NO: 562064 - DNA, 22 bp, Homo sapiens
tagaggccttttagtgagttga

SEQ ID NO: 562065 - DNA, 22 bp, Homo sapiens
ttgtgatgtgttgtgatagctg

SEQ ID NO: 562066 - DNA, 22 bp, Homo sapiens
ttctcaagagggaggcaatcat

SEQ ID NO: 562067 - DNA, 22 bp, Homo sapiens
tccatcacatttagaataaaat

SEQ ID NO: 562068 - DNA, 22 bp, Homo sapiens
tgtggaatccatcattttatta

SEQ ID NO: 562069 - DNA, 22 bp, Homo sapiens
tgtaaagccaggcaataagagg

SEQ ID NO: 562070 - DNA, 22 bp, Homo sapiens
cttttaagctatttgtctccat

SEQ ID NO: 562071 - DNA, 22 bp, Homo sapiens
ccatggtgttattcaatagata

SEQ ID NO: 562072 - DNA, 22 bp, Homo sapiens
tttcttcttctattttcctgga

SEQ ID NO: 562073 - DNA, 22 bp, Homo sapiens
accaaataaaggcttttgggcc

SEQ ID NO: 562074 - DNA, 22 bp, Homo sapiens
ccaccgtctctgcacagacctc

SEQ ID NO: 562075 - DNA, 22 bp, Homo sapiens
gcctcgcccatgcccagcggct

SEQ ID NO: 562076 - DNA, 22 bp, Homo sapiens
tgtcatgtaatgtatcatagca

SEQ ID NO: 562077 - DNA, 22 bp, Homo sapiens
cccacaggcacgactggtttgg

SEQ ID NO: 562078 - DNA, 22 bp, Homo sapiens
cccctttggcttctggcttctc

SEQ ID NO: 562079 - DNA, 22 bp, Homo sapiens
agcattccacaatggatcagtt

SEQ ID NO: 562080 - DNA, 22 bp, Homo sapiens
agtgagccccagtatgtcttaa

SEQ ID NO: 562081 - DNA, 22 bp, Homo sapiens
tctgttactacgcaccaccctt

SEQ ID NO: 562082 - DNA, 22 bp, Homo sapiens
tctacagaaacagcggcaggtt

SEQ ID NO: 562083 - DNA, 22 bp, Homo sapiens
cgaggcagacaaaagttggaag

SEQ ID NO: 562084 - DNA, 22 bp, Homo sapiens
cccagatccatctggaagccag

SEQ ID NO: 562085 - DNA, 22 bp, Homo sapiens
cagtgtgtgtgggatggggctg

SEQ ID NO: 562086 - DNA, 22 bp, Homo sapiens
tggcattagtgggaggggagca

SEQ ID NO: 562087 - DNA, 22 bp, Homo sapiens
tcatgaaggcgcattgagggga

SEQ ID NO: 562088 - DNA, 22 bp, Homo sapiens
ctgtcctaaggttgttgagttg

SEQ ID NO: 562089 - DNA, 22 bp, Homo sapiens
agcacgggtggtctggcaggga

SEQ ID NO: 562090 - DNA, 22 bp, Homo sapiens
cagttctgtctaggcagtggct

SEQ ID NO: 562091 - DNA, 22 bp, Homo sapiens
tgctcacactgcagcagtctgc

SEQ ID NO: 562092 - DNA, 22 bp, Homo sapiens
cgcctgaaacacggatcccagc

SEQ ID NO: 562093 - DNA, 22 bp, Homo sapiens
gccctgaagattgatgtggaag

SEQ ID NO: 562094 - DNA, 22 bp, Homo sapiens
agctttcttttggtggagaagg

SEQ ID NO: 562095 - DNA, 22 bp, Homo sapiens
tgggaggacagagggaggaagt

SEQ ID NO: 562096 - DNA, 22 bp, Homo sapiens
gggtagtgggaaaggcaaggct

SEQ ID NO: 562097 - DNA, 22 bp, Homo sapiens
agaaattatccttggtgtgttc

SEQ ID NO: 562098 - DNA, 22 bp, Homo sapiens
tgaaagggttattcatctcgag

SEQ ID NO: 562099 - DNA, 22 bp, Homo sapiens
tctccagtgtccaggagaattc

SEQ ID NO: 562100 - DNA, 22 bp, Homo sapiens
tgcaggtggctaattgtccatg

SEQ ID NO: 562101 - DNA, 22 bp, Homo sapiens
ttatattttgttctaaaatgtg

SEQ ID NO: 562102 - DNA, 22 bp, Homo sapiens
gaaatcgtactgtcatttgttt

SEQ ID NO: 562103 - DNA, 22 bp, Homo sapiens
tcctctaccttttctcccaatt

SEQ ID NO: 562104 - DNA, 22 bp, Homo sapiens
ccagctctcaacggccctttgg

SEQ ID NO: 562105 - DNA, 22 bp, Homo sapiens
tcacatacaagagatggtggat

SEQ ID NO: 562106 - DNA, 22 bp, Homo sapiens
attacatctgagcctctggccc

SEQ ID NO: 562107 - DNA, 22 bp, Homo sapiens
tgtctctattctaggagctgct

SEQ ID NO: 562108 - DNA, 22 bp, Homo sapiens
tcccccagtgcccacctcagtg

SEQ ID NO: 562109 - DNA, 22 bp, Homo sapiens
tgagccccaggcttcagttgag

SEQ ID NO: 562110 - DNA, 22 bp, Homo sapiens
gacctctgtgaagccagtacgg

SEQ ID NO: 562111 - DNA, 22 bp, Homo sapiens
taagtactggatgaatgaatga

SEQ ID NO: 562112 - DNA, 22 bp, Homo sapiens
tcagagaggcagggcatggggg

SEQ ID NO: 562113 - DNA, 22 bp, Homo sapiens
tcacagtggcgtgacagccatg

SEQ ID NO: 562114 - DNA, 22 bp, Homo sapiens
agtctgctggagtcttggcttc

SEQ ID NO: 562115 - DNA, 22 bp, Homo sapiens
cggtgattagatcatgttatgg

SEQ ID NO: 562116 - DNA, 22 bp, Homo sapiens
tgaggatgtttagaacctatgg

SEQ ID NO: 562117 - DNA, 22 bp, Homo sapiens
gaagctactgccagcagcctgc

SEQ ID NO: 562118 - DNA, 22 bp, Homo sapiens
agggagcagcgctggggcctcc

SEQ ID NO: 562119 - DNA, 22 bp, Homo sapiens
tctaccttaccttctcctctat

SEQ ID NO: 562120 - DNA, 22 bp, Homo sapiens
gcgaggctgtccttgggctcct

SEQ ID NO: 562121 - DNA, 22 bp, Homo sapiens
agttcctctgctggttttttca

SEQ ID NO: 562122 - DNA, 22 bp, Homo sapiens
cacgcatgaccccaagtcttag

SEQ ID NO: 562123 - DNA, 22 bp, Homo sapiens
tgcctccacatggctgaggtgt

SEQ ID NO: 562124 - DNA, 22 bp, Homo sapiens
cctggttctgtgtccacctggc

SEQ ID NO: 562125 - DNA, 22 bp, Homo sapiens
tagttatgtttgcaaggaggga

SEQ ID NO: 562126 - DNA, 22 bp, Homo sapiens
agttacttgctcaagactggaa

SEQ ID NO: 562127 - DNA, 22 bp, Homo sapiens
ccagagtccagggctctgcggg

SEQ ID NO: 562128 - DNA, 22 bp, Homo sapiens
tgccagaagaggaggggttagc

SEQ ID NO: 562129 - DNA, 22 bp, Homo sapiens
ttattattcttgaagataagta

SEQ ID NO: 562130 - DNA, 22 bp, Homo sapiens
gggccatcaaatttggagctta

SEQ ID NO: 562131 - DNA, 22 bp, Homo sapiens
aaatgggcccacacattggagc

SEQ ID NO: 562132 - DNA, 22 bp, Homo sapiens
caaaaatagcaccatttgcctc

SEQ ID NO: 562133 - DNA, 22 bp, Homo sapiens
ggctgacaatggctccttgtgt

SEQ ID NO: 562134 - DNA, 22 bp, Homo sapiens
ttttctgtccccagaatgtggc

SEQ ID NO: 562135 - DNA, 22 bp, Homo sapiens
ttatgggagacgggatgatgag

SEQ ID NO: 562136 - DNA, 22 bp, Homo sapiens
taaatttttcagcgtggctttt

SEQ ID NO: 562137 - DNA, 22 bp, Homo sapiens
tgtaccccagagtagatgctta

SEQ ID NO: 562138 - DNA, 22 bp, Homo sapiens
aggcgaagtcagagagctcttc

SEQ ID NO: 562139 - DNA, 22 bp, Homo sapiens
tagcgttcctggaaacaggtgt

SEQ ID NO: 562140 - DNA, 22 bp, Homo sapiens
tccagaactgttctgggggtgg

SEQ ID NO: 562141 - DNA, 22 bp, Homo sapiens
tagcgttattaccatggtttaa

SEQ ID NO: 562142 - DNA, 22 bp, Homo sapiens
tgtttgaaagctgttgccctca

SEQ ID NO: 562143 - DNA, 22 bp, Homo sapiens
cacaaggtattggtattacctt

SEQ ID NO: 562144 - DNA, 22 bp, Homo sapiens
gtggacgcagccgagggagcag

SEQ ID NO: 562145 - DNA, 22 bp, Homo sapiens
tccatcaaaaacacaatagcac

SEQ ID NO: 562146 - DNA, 22 bp, Homo sapiens
tgtgacagattgataactgaaa

SEQ ID NO: 562147 - DNA, 22 bp, Homo sapiens
agagtgatcagggattgcatgg

SEQ ID NO: 562148 - DNA, 22 bp, Homo sapiens
tgtctgaatgctgttgcttgcc

SEQ ID NO: 562149 - DNA, 22 bp, Homo sapiens
cgtgctcatgaccactgggtgg

SEQ ID NO: 562150 - DNA, 22 bp, Homo sapiens
tatggtaatgactgatttcttt

SEQ ID NO: 562151 - DNA, 22 bp, Homo sapiens
tgttgaaacaatctctactgaa

SEQ ID NO: 562152 - DNA, 22 bp, Homo sapiens
tcaaatattatgcagcttggat

SEQ ID NO: 562153 - DNA, 22 bp, Homo sapiens
cgggtacctggccaggcccctt

SEQ ID NO: 562154 - DNA, 22 bp, Homo sapiens
cttgttcagatcttacacactg

SEQ ID NO: 562155 - DNA, 22 bp, Homo sapiens
agtagaaaatctgacacaagag

SEQ ID NO: 562156 - DNA, 22 bp, Homo sapiens
gctgtgtggtgggaggcgaggg

SEQ ID NO: 562157 - DNA, 22 bp, Homo sapiens
tagaagtagttctgagccacac

SEQ ID NO: 562158 - DNA, 22 bp, Homo sapiens
aggaccgggagggcaggaatgg

SEQ ID NO: 562159 - DNA, 22 bp, Homo sapiens
tggagttcagatcctgtgccta

SEQ ID NO: 562160 - DNA, 22 bp, Homo sapiens
tcagcaagacaattaatgagga

SEQ ID NO: 562161 - DNA, 22 bp, Homo sapiens
tgactgatgtctggggcagagt

SEQ ID NO: 562162 - DNA, 22 bp, Homo sapiens
aattgtccaggtcatttgatgg

SEQ ID NO: 562163 - DNA, 22 bp, Homo sapiens
tgtttcattgctatgatctctt

SEQ ID NO: 562164 - DNA, 22 bp, Homo sapiens
caccactgcgcctgcgcggcgc

SEQ ID NO: 562165 - DNA, 22 bp, Homo sapiens
taccatttgatttaatttttaa

SEQ ID NO: 562166 - DNA, 22 bp, Homo sapiens
ttgtaactaagcagttactttg

SEQ ID NO: 562167 - DNA, 22 bp, Homo sapiens
aggagaaaggaaggaacagggg

SEQ ID NO: 562168 - DNA, 22 bp, Homo sapiens
gcccctgccccgcccccccagg

SEQ ID NO: 562169 - DNA, 22 bp, Homo sapiens
gagcaccaggagcgtgccgccc

SEQ ID NO: 562170 - DNA, 22 bp, Homo sapiens
tccccctttggtttctcctagc

SEQ ID NO: 562171 - DNA, 22 bp, Homo sapiens
aataaagtcaggcagtggagga

SEQ ID NO: 562172 - DNA, 22 bp, Homo sapiens
atcacttactaggattgaagaa

SEQ ID NO: 562173 - DNA, 22 bp, Homo sapiens
tccctgcccctcctccttggct

SEQ ID NO: 562174 - DNA, 22 bp, Homo sapiens
ccttcttctctcagctcttttg

SEQ ID NO: 562175 - DNA, 22 bp, Homo sapiens
tttctctgagggacagagtggt

SEQ ID NO: 562176 - DNA, 22 bp, Homo sapiens
tttatcttgactggattgctta

SEQ ID NO: 562177 - DNA, 22 bp, Homo sapiens
aaagcgctaatttctgccttct

SEQ ID NO: 562178 - DNA, 22 bp, Homo sapiens
tgagttagaattggtttgtttt

SEQ ID NO: 562179 - DNA, 22 bp, Homo sapiens
accactggcttatgggacattc

SEQ ID NO: 562180 - DNA, 22 bp, Homo sapiens
taaaacggacatggtgatagat

SEQ ID NO: 562181 - DNA, 22 bp, Homo sapiens
tgggatagaaggcctgcagggg

SEQ ID NO: 562182 - DNA, 22 bp, Homo sapiens
tgggattttaccttggccatct

SEQ ID NO: 562183 - DNA, 22 bp, Homo sapiens
tgctggcagagcacagctatct

SEQ ID NO: 562184 - DNA, 22 bp, Homo sapiens
gccacacccaatggatcatagg

SEQ ID NO: 562185 - DNA, 22 bp, Homo sapiens
caggcagcaggagccctgctcg

SEQ ID NO: 562186 - DNA, 22 bp, Homo sapiens
taccctcctctggcctccctcc

SEQ ID NO: 562187 - DNA, 22 bp, Homo sapiens
tgaccccaaaacagctggttaa

SEQ ID NO: 562188 - DNA, 22 bp, Homo sapiens
gactatctattgtcttcttcat

SEQ ID NO: 562189 - DNA, 22 bp, Homo sapiens
tggggggtggggagaatgggca

SEQ ID NO: 562190 - DNA, 22 bp, Homo sapiens
ccgagcctgggctgtctcagac

SEQ ID NO: 562191 - DNA, 22 bp, Homo sapiens
cacagccttagtggaagccctg

SEQ ID NO: 562192 - DNA, 22 bp, Homo sapiens
aaccctatcacttaggcactat

SEQ ID NO: 562193 - DNA, 22 bp, Homo sapiens
ggtttagtatgttcatatgtga

SEQ ID NO: 562194 - DNA, 22 bp, Homo sapiens
tgaaacttggcttttagctgca

SEQ ID NO: 562195 - DNA, 22 bp, Homo sapiens
tattcagaggctttctgggctg

SEQ ID NO: 562196 - DNA, 22 bp, Homo sapiens
gcctgatttcccttagggcccc

SEQ ID NO: 562197 - DNA, 22 bp, Homo sapiens
agataatctatgcagcattttt

SEQ ID NO: 562198 - DNA, 22 bp, Homo sapiens
gggagaggcggcgcaggggccc

SEQ ID NO: 562199 - DNA, 22 bp, Homo sapiens
agagctgcttggagagccttcc

SEQ ID NO: 562200 - DNA, 22 bp, Homo sapiens
acagatttcctaagcatcaatc

SEQ ID NO: 562201 - DNA, 22 bp, Homo sapiens
gaagaccctaggactccctcct

SEQ ID NO: 562202 - DNA, 22 bp, Homo sapiens
ttttgcagcctggtgaggaaat

SEQ ID NO: 562203 - DNA, 22 bp, Homo sapiens
gaggggaagggcaggggagaag

SEQ ID NO: 562204 - DNA, 22 bp, Homo sapiens
ggatatacttcatgggcctgtg

SEQ ID NO: 562205 - DNA, 22 bp, Homo sapiens
acaaaggtattctcattttgga

SEQ ID NO: 562206 - DNA, 22 bp, Homo sapiens
ctctgatttttcacttgcctca

SEQ ID NO: 562207 - DNA, 22 bp, Homo sapiens
ctttgaacagtcagtcctaaga

SEQ ID NO: 562208 - DNA, 22 bp, Homo sapiens
gagagcacgctgagcaggcccg

SEQ ID NO: 562209 - DNA, 22 bp, Homo sapiens
tcccctccttccctggtgtcag

SEQ ID NO: 562210 - DNA, 22 bp, Homo sapiens
ccctctctgctacatttcttgg

SEQ ID NO: 562211 - DNA, 22 bp, Homo sapiens
tagttgactggccatggtaagc

SEQ ID NO: 562212 - DNA, 22 bp, Homo sapiens
gaatttcccgtggcatctgata

SEQ ID NO: 562213 - DNA, 22 bp, Homo sapiens
tggtctcaaggacaggacctta

SEQ ID NO: 562214 - DNA, 22 bp, Homo sapiens
gtgacttgagcctgtctgcttc

SEQ ID NO: 562215 - DNA, 22 bp, Homo sapiens
tctgtgaaagggagtgtgatac

SEQ ID NO: 562216 - DNA, 22 bp, Homo sapiens
tatcttgcagccagccgctggg

SEQ ID NO: 562217 - DNA, 22 bp, Homo sapiens
acctgatttccacccacctgta

SEQ ID NO: 562218 - DNA, 22 bp, Homo sapiens
ttgcttccctcctgtgagatct

SEQ ID NO: 562219 - DNA, 22 bp, Homo sapiens
tccccagctctctcctccctct

SEQ ID NO: 562220 - DNA, 22 bp, Homo sapiens
atcactgtttccatctaggcag

SEQ ID NO: 562221 - DNA, 22 bp, Homo sapiens
tcctgtggctgtatttggccag

SEQ ID NO: 562222 - DNA, 22 bp, Homo sapiens
ctgctattcttaacctgcctac

SEQ ID NO: 562223 - DNA, 22 bp, Homo sapiens
catggacctttttctggtccaa

SEQ ID NO: 562224 - DNA, 22 bp, Homo sapiens
ccagtgctccttggttatcctt

SEQ ID NO: 562225 - DNA, 22 bp, Homo sapiens
cagtctcagtgggctttgactt

SEQ ID NO: 562226 - DNA, 22 bp, Homo sapiens
gaggttggcatcagaccctctt

SEQ ID NO: 562227 - DNA, 22 bp, Homo sapiens
tccaactgagctttgctttgct

SEQ ID NO: 562228 - DNA, 22 bp, Homo sapiens
agagcgggtagaggatctttag

SEQ ID NO: 562229 - DNA, 22 bp, Homo sapiens
gggctgtgttggggacctgagc

SEQ ID NO: 562230 - DNA, 22 bp, Homo sapiens
gctctgaaaggttcctccttag

SEQ ID NO: 562231 - DNA, 22 bp, Homo sapiens
tagcctgaaaatagagatggtc

SEQ ID NO: 562232 - DNA, 22 bp, Homo sapiens
ggacaggcccagggcggggcca

SEQ ID NO: 562233 - DNA, 22 bp, Homo sapiens
tttgaattcttgttctgcatcc

SEQ ID NO: 562234 - DNA, 22 bp, Homo sapiens
ggatgagaatggggcagtaagg

SEQ ID NO: 562235 - DNA, 22 bp, Homo sapiens
tgtggcctgttctgccttctga

SEQ ID NO: 562236 - DNA, 22 bp, Homo sapiens
tcagctgcggtgcagcgtgggt

SEQ ID NO: 562237 - DNA, 22 bp, Homo sapiens
taattgagaatgcaatctacta

SEQ ID NO: 562238 - DNA, 22 bp, Homo sapiens
agtgcgcctcgggtgagcatgc

SEQ ID NO: 562239 - DNA, 22 bp, Homo sapiens
tcgggaagccagaggccccatg

SEQ ID NO: 562240 - DNA, 22 bp, Homo sapiens
tcttgatgttgctgcccataag

SEQ ID NO: 562241 - DNA, 22 bp, Homo sapiens
tgatagacactggttctaggtg

SEQ ID NO: 562242 - DNA, 22 bp, Homo sapiens
tattgtcccaatagatgctcat

SEQ ID NO: 562243 - DNA, 22 bp, Homo sapiens
tttggcttttaaaactagaagt

SEQ ID NO: 562244 - DNA, 22 bp, Homo sapiens
taatgattttacgggcagttga

SEQ ID NO: 562245 - DNA, 22 bp, Homo sapiens
tttttattttgttttactgctt

SEQ ID NO: 562246 - DNA, 22 bp, Homo sapiens
tgtctgctcctgccctgctcgg

SEQ ID NO: 562247 - DNA, 22 bp, Homo sapiens
aggagggcagggcggtgggaag

SEQ ID NO: 562248 - DNA, 22 bp, Homo sapiens
tgaaaacattggcttctaaaag

SEQ ID NO: 562249 - DNA, 22 bp, Homo sapiens
agaggctggccgtgatgaattc

SEQ ID NO: 562250 - DNA, 22 bp, Homo sapiens
caggctctaaactaaatggctg

SEQ ID NO: 562251 - DNA, 22 bp, Homo sapiens
ttgcctgtatctcatttatcct

SEQ ID NO: 562252 - DNA, 22 bp, Homo sapiens
acaccgcaaatatcttctgatc

SEQ ID NO: 562253 - DNA, 22 bp, Homo sapiens
ccctctcactctgtccctcagt

SEQ ID NO: 562254 - DNA, 22 bp, Homo sapiens
tatgtcaggcctcattctacct

SEQ ID NO: 562255 - DNA, 22 bp, Homo sapiens
agagggttggaggatgtaggag

SEQ ID NO: 562256 - DNA, 22 bp, Homo sapiens
tgtctctccagtagtagctatt

SEQ ID NO: 562257 - DNA, 22 bp, Homo sapiens
aagggagaaaggctctctcctg

SEQ ID NO: 562258 - DNA, 22 bp, Homo sapiens
aagttcttgttgctggatttgg

SEQ ID NO: 562259 - DNA, 22 bp, Homo sapiens
cactctcttagatgaaaaccct

SEQ ID NO: 562260 - DNA, 22 bp, Homo sapiens
taatgctttttgtcatactcat

SEQ ID NO: 562261 - DNA, 22 bp, Homo sapiens
tatgggggatgtcaggcaggcc

SEQ ID NO: 562262 - DNA, 22 bp, Homo sapiens
tattaatgcagggatcatggta

SEQ ID NO: 562263 - DNA, 22 bp, Homo sapiens
tggggcttgaatggggttccat

SEQ ID NO: 562264 - DNA, 22 bp, Homo sapiens
cagccattctcctgataccctc

SEQ ID NO: 562265 - DNA, 22 bp, Homo sapiens
gaggtaaagatggggagggcta

SEQ ID NO: 562266 - DNA, 22 bp, Homo sapiens
ttggttcaaatgacttgggcca

SEQ ID NO: 562267 - DNA, 22 bp, Homo sapiens
tgcttgttttgtggcttcagct

SEQ ID NO: 562268 - DNA, 22 bp, Homo sapiens
tctcccttgagctttgacacac

SEQ ID NO: 562269 - DNA, 22 bp, Homo sapiens
actcccagccctgttcctgtcc

SEQ ID NO: 562270 - DNA, 22 bp, Homo sapiens
gagcaggacctgtagggcctgc

SEQ ID NO: 562271 - DNA, 22 bp, Homo sapiens
tagcgtgtttttcacatagggt

SEQ ID NO: 562272 - DNA, 22 bp, Homo sapiens
cggatttaatgagaaatattga

SEQ ID NO: 562273 - DNA, 22 bp, Homo sapiens
taaagctccagttaaatagctt

SEQ ID NO: 562274 - DNA, 22 bp, Homo sapiens
tgggggcaggagggacaggggt

SEQ ID NO: 562275 - DNA, 22 bp, Homo sapiens
tgtgcagacacacatatctata

SEQ ID NO: 562276 - DNA, 22 bp, Homo sapiens
aggaggggaggggaggtggaag

SEQ ID NO: 562277 - DNA, 22 bp, Homo sapiens
tctagactccaaattgcagact

SEQ ID NO: 562278 - DNA, 22 bp, Homo sapiens
gtcactcttcatttattcatcc

SEQ ID NO: 562279 - DNA, 22 bp, Homo sapiens
tgagagaaccactgcttccttc

SEQ ID NO: 562280 - DNA, 22 bp, Homo sapiens
ggacaggtgacatgttcttcaa

SEQ ID NO: 562281 - DNA, 22 bp, Homo sapiens
tcagatgacaatgtcaggtgct

SEQ ID NO: 562282 - DNA, 22 bp, Homo sapiens
tgccttgagaaatggaaaggtc

SEQ ID NO: 562283 - DNA, 22 bp, Homo sapiens
ggtgggagatgagaagggccaa

SEQ ID NO: 562284 - DNA, 22 bp, Homo sapiens
tctcctctgtcctcaccccttt

SEQ ID NO: 562285 - DNA, 22 bp, Homo sapiens
tggggccttcgggtcctgtggg

SEQ ID NO: 562286 - DNA, 22 bp, Homo sapiens
tggctccgtgttctttctttct

SEQ ID NO: 562287 - DNA, 22 bp, Homo sapiens
agggagggggaagagcaagaca

SEQ ID NO: 562288 - DNA, 22 bp, Homo sapiens
tgctgtgggaatgggaatgggg

SEQ ID NO: 562289 - DNA, 22 bp, Homo sapiens
agtttattttattgtttatttc

SEQ ID NO: 562290 - DNA, 22 bp, Homo sapiens
ccccaaagcctatgcttttctc

SEQ ID NO: 562291 - DNA, 22 bp, Homo sapiens
tcagggctgtgcacagaaggcg

SEQ ID NO: 562292 - DNA, 22 bp, Homo sapiens
cagactgttacctaaatttggg

SEQ ID NO: 562293 - DNA, 22 bp, Homo sapiens
tgccctttctatatgatgtaat

SEQ ID NO: 562294 - DNA, 22 bp, Homo sapiens
caccccaagtgtgttgtgaggc

SEQ ID NO: 562295 - DNA, 22 bp, Homo sapiens
caccagcctcctcttttcctga

SEQ ID NO: 562296 - DNA, 22 bp, Homo sapiens
tctggacaaggccggtgaagct

SEQ ID NO: 562297 - DNA, 22 bp, Homo sapiens
tattttttgtctgtaaatcctt

SEQ ID NO: 562298 - DNA, 22 bp, Homo sapiens
atctccagcactccaaccacag

SEQ ID NO: 562299 - DNA, 22 bp, Homo sapiens
tgctcatttaaccatttagata

SEQ ID NO: 562300 - DNA, 22 bp, Homo sapiens
cactgaagcctcagttttctca

SEQ ID NO: 562301 - DNA, 22 bp, Homo sapiens
tcgggggtcacagtgggtcggg

SEQ ID NO: 562302 - DNA, 22 bp, Homo sapiens
tggctctgggaccttcagttct

SEQ ID NO: 562303 - DNA, 22 bp, Homo sapiens
cccagcacatctctccattttt

SEQ ID NO: 562304 - DNA, 22 bp, Homo sapiens
gagactcacaagttcctgcaaa

SEQ ID NO: 562305 - DNA, 22 bp, Homo sapiens
cctgccgccttctgtccattcc

SEQ ID NO: 562306 - DNA, 22 bp, Homo sapiens
ccaggggctccagctaccccat

SEQ ID NO: 562307 - DNA, 22 bp, Homo sapiens
ccccccaccaacttctgactgg

SEQ ID NO: 562308 - DNA, 22 bp, Homo sapiens
ttcagtgtactgtgaatgtata

SEQ ID NO: 562309 - DNA, 22 bp, Homo sapiens
cagtgtccctagtgtcaaggct

SEQ ID NO: 562310 - DNA, 22 bp, Homo sapiens
gacagccacaggctgagggata

SEQ ID NO: 562311 - DNA, 22 bp, Homo sapiens
tgttggaggacattaggaaggg

SEQ ID NO: 562312 - DNA, 22 bp, Homo sapiens
gtaacagtgtaggcaggtaaga

SEQ ID NO: 562313 - DNA, 22 bp, Homo sapiens
tgtctttagccacttgcctctt

SEQ ID NO: 562314 - DNA, 22 bp, Homo sapiens
ggaaccctcggggttttcctct

SEQ ID NO: 562315 - DNA, 22 bp, Homo sapiens
gtggtgatggggcatcagccgc

SEQ ID NO: 562316 - DNA, 22 bp, Homo sapiens
tctctcccaggtcttcctttcc

SEQ ID NO: 562317 - DNA, 22 bp, Homo sapiens
tgggaatgccaacctgcttatt

SEQ ID NO: 562318 - DNA, 22 bp, Homo sapiens
tgaggggcaaggatgggcatgc

SEQ ID NO: 562319 - DNA, 22 bp, Homo sapiens
gagaagtggagaggttgatcta

SEQ ID NO: 562320 - DNA, 22 bp, Homo sapiens
ttttcctacccactgcccatct

SEQ ID NO: 562321 - DNA, 22 bp, Homo sapiens
taggggtggggcaaaggggcat

SEQ ID NO: 562322 - DNA, 22 bp, Homo sapiens
cacctgtccctgcccagctctg

SEQ ID NO: 562323 - DNA, 22 bp, Homo sapiens
ttctttaggtgctgagccttct

SEQ ID NO: 562324 - DNA, 22 bp, Homo sapiens
tttggtccttccattggtccta

SEQ ID NO: 562325 - DNA, 22 bp, Homo sapiens
tgaagatgtagtgatgggaatt

SEQ ID NO: 562326 - DNA, 22 bp, Homo sapiens
tgaggaggaggtgcgggaaagg

SEQ ID NO: 562327 - DNA, 22 bp, Homo sapiens
gaaggtggaggtggtgtagttg

SEQ ID NO: 562328 - DNA, 22 bp, Homo sapiens
tgtgcagaaggtagaatgttga

SEQ ID NO: 562329 - DNA, 22 bp, Homo sapiens
tcccttttctcttacatttttt

SEQ ID NO: 562330 - DNA, 22 bp, Homo sapiens
gattgggaactgctattccgtg

SEQ ID NO: 562331 - DNA, 22 bp, Homo sapiens
tgccctcccatgtccctggcag

SEQ ID NO: 562332 - DNA, 22 bp, Homo sapiens
ccaggctgctctttcttgtggt

SEQ ID NO: 562333 - DNA, 22 bp, Homo sapiens
ctaggtccctctgagggtcact

SEQ ID NO: 562334 - DNA, 22 bp, Homo sapiens
tgtagatgctgaaacatggagg

SEQ ID NO: 562335 - DNA, 22 bp, Homo sapiens
cagcggccgacgcggcggcgcc

SEQ ID NO: 562336 - DNA, 22 bp, Homo sapiens
cgctcgatgaggcccacgaggt

SEQ ID NO: 562337 - DNA, 22 bp, Homo sapiens
gaagggattataatttgataat

SEQ ID NO: 562338 - DNA, 22 bp, Homo sapiens
tatcttttctctgagagcaagg

SEQ ID NO: 562339 - DNA, 22 bp, Homo sapiens
tgtaattggggaaactgaggtc

SEQ ID NO: 562340 - DNA, 22 bp, Homo sapiens
tgggggcaggatttgaccccag

SEQ ID NO: 562341 - DNA, 22 bp, Homo sapiens
agaggtggcatggagcctggct

SEQ ID NO: 562342 - DNA, 22 bp, Homo sapiens
aatggcttctcagtttcataat

SEQ ID NO: 562343 - DNA, 22 bp, Homo sapiens
ttgggactaacagaaaattggc

SEQ ID NO: 562344 - DNA, 22 bp, Homo sapiens
tgctgacctgcccagggtgtgt

SEQ ID NO: 562345 - DNA, 22 bp, Homo sapiens
tagtgacaagaatgactggaaa

SEQ ID NO: 562346 - DNA, 22 bp, Homo sapiens
gtggaccttgaaggcctcttct

SEQ ID NO: 562347 - DNA, 22 bp, Homo sapiens
tctactccacatcctccctaaa

SEQ ID NO: 562348 - DNA, 22 bp, Homo sapiens
ccttggtgggttgccagacatt

SEQ ID NO: 562349 - DNA, 22 bp, Homo sapiens
acccagtccccgggcagcaggc

SEQ ID NO: 562350 - DNA, 22 bp, Homo sapiens
tagatgcttataggcatattag

SEQ ID NO: 562351 - DNA, 22 bp, Homo sapiens
cactgcctcccacaggggcttg

SEQ ID NO: 562352 - DNA, 22 bp, Homo sapiens
gcgtcagaaggtcaggctgtcc

SEQ ID NO: 562353 - DNA, 22 bp, Homo sapiens
caggcttccatccagcttaacg

SEQ ID NO: 562354 - DNA, 22 bp, Homo sapiens
agttgcaaactgtctccttagc

SEQ ID NO: 562355 - DNA, 22 bp, Homo sapiens
tttggttctgttccacctcaaa

SEQ ID NO: 562356 - DNA, 22 bp, Homo sapiens
gactgaagtgctttcctcaatg

SEQ ID NO: 562357 - DNA, 22 bp, Homo sapiens
agaaggacagtgtgtttgttgg

SEQ ID NO: 562358 - DNA, 22 bp, Homo sapiens
tacactcagcccaggaggagca

SEQ ID NO: 562359 - DNA, 22 bp, Homo sapiens
aattgtttttctctgacctgaa

SEQ ID NO: 562360 - DNA, 22 bp, Homo sapiens
ccattagaagggctggaagaag

SEQ ID NO: 562361 - DNA, 22 bp, Homo sapiens
tctgctgtccctgactgtcact

SEQ ID NO: 562362 - DNA, 22 bp, Homo sapiens
ggcagagaggttggattggatg

SEQ ID NO: 562363 - DNA, 22 bp, Homo sapiens
agtttccccatttgaacagtgt

SEQ ID NO: 562364 - DNA, 22 bp, Homo sapiens
tgtcctcgtccgcctcgaactc

SEQ ID NO: 562365 - DNA, 22 bp, Homo sapiens
tcacctgtcttttttgtgggat

SEQ ID NO: 562366 - DNA, 22 bp, Homo sapiens
aaaactttctttgggaaaggtt

SEQ ID NO: 562367 - DNA, 22 bp, Homo sapiens
gggtaggtgggatactataaca

SEQ ID NO: 562368 - DNA, 22 bp, Homo sapiens
aggtaagggctgcaggttctct

SEQ ID NO: 562369 - DNA, 22 bp, Homo sapiens
gagctaaacttgaactgaacat

SEQ ID NO: 562370 - DNA, 22 bp, Homo sapiens
tcccctttacccatggagctca

SEQ ID NO: 562371 - DNA, 22 bp, Homo sapiens
cggagaggggcggggccaggcg

SEQ ID NO: 562372 - DNA, 22 bp, Homo sapiens
acatgccctggaactaggaaca

SEQ ID NO: 562373 - DNA, 22 bp, Homo sapiens
tgcttcttattagcagtaattc

SEQ ID NO: 562374 - DNA, 22 bp, Homo sapiens
tttagtgagcacctgctgcatg

SEQ ID NO: 562375 - DNA, 22 bp, Homo sapiens
catgcctgggagccagatgggg

SEQ ID NO: 562376 - DNA, 22 bp, Homo sapiens
tcggggtcttttgttttgggat

SEQ ID NO: 562377 - DNA, 22 bp, Homo sapiens
gagagataagggtcatgtgtca

SEQ ID NO: 562378 - DNA, 22 bp, Homo sapiens
tgccagcatagtgctcctggac

SEQ ID NO: 562379 - DNA, 22 bp, Homo sapiens
gccccttcgtgtgcctacctgg

SEQ ID NO: 562380 - DNA, 22 bp, Homo sapiens
agttcctgaggttttctgtgcc

SEQ ID NO: 562381 - DNA, 22 bp, Homo sapiens
tgatgaattaactcagctccaa

SEQ ID NO: 562382 - DNA, 22 bp, Homo sapiens
tgaaactctagctttcagcact

SEQ ID NO: 562383 - DNA, 22 bp, Homo sapiens
gcctcctatttcagattctcac

SEQ ID NO: 562384 - DNA, 22 bp, Homo sapiens
aacatagtggacacatccctgc

SEQ ID NO: 562385 - DNA, 22 bp, Homo sapiens
cagctgcccctctgccccggga

SEQ ID NO: 562386 - DNA, 22 bp, Homo sapiens
tgttaaggacctggaaaaaaaa

SEQ ID NO: 562387 - DNA, 22 bp, Homo sapiens
aatcatggtgtaattgaaggac

SEQ ID NO: 562388 - DNA, 22 bp, Homo sapiens
ctttgtgactgggcttgagaac

SEQ ID NO: 562389 - DNA, 22 bp, Homo sapiens
tgcaagagaaaattctgatgag

SEQ ID NO: 562390 - DNA, 22 bp, Homo sapiens
cccagcacagtgcctggcacac

SEQ ID NO: 562391 - DNA, 22 bp, Homo sapiens
tattgtgtttgcagagctctgg

SEQ ID NO: 562392 - DNA, 22 bp, Homo sapiens
tgctgttagggggagaaggaac

SEQ ID NO: 562393 - DNA, 22 bp, Homo sapiens
ggtcttgtccttttttggcttc

SEQ ID NO: 562394 - DNA, 22 bp, Homo sapiens
cttcagcactttccagaaggtg

SEQ ID NO: 562395 - DNA, 22 bp, Homo sapiens
tggttttcctttctgacccttc

SEQ ID NO: 562396 - DNA, 22 bp, Homo sapiens
aaacaaatttcaagctgtgaca

SEQ ID NO: 562397 - DNA, 22 bp, Homo sapiens
ggaaatgagagccaagctcctg

SEQ ID NO: 562398 - DNA, 22 bp, Homo sapiens
ttttgggagctggccgtaggca

SEQ ID NO: 562399 - DNA, 22 bp, Homo sapiens
gtgggtccctttggtttcatcc

SEQ ID NO: 562400 - DNA, 22 bp, Homo sapiens
tttccttccaggttcctaaggc

SEQ ID NO: 562401 - DNA, 22 bp, Homo sapiens
cccactctgatggcctgctggg

SEQ ID NO: 562402 - DNA, 22 bp, Homo sapiens
ccagaggctccagtctctattt

SEQ ID NO: 562403 - DNA, 22 bp, Homo sapiens
ggggaaggggcacggagcggaa

SEQ ID NO: 562404 - DNA, 22 bp, Homo sapiens
tgggagtgaggacgagaggccc

SEQ ID NO: 562405 - DNA, 22 bp, Homo sapiens
acttcaggataaacaggaaagg

SEQ ID NO: 562406 - DNA, 22 bp, Homo sapiens
tcctttctcctgccctttccca

SEQ ID NO: 562407 - DNA, 22 bp, Homo sapiens
tagaaaagctactggctaaaaa

SEQ ID NO: 562408 - DNA, 22 bp, Homo sapiens
tccccagggtgcaggtccatct

SEQ ID NO: 562409 - DNA, 22 bp, Homo sapiens
tgaagccgagagttgagtggcc

SEQ ID NO: 562410 - DNA, 22 bp, Homo sapiens
acccctagatatcaacatatag

SEQ ID NO: 562411 - DNA, 22 bp, Homo sapiens
gagagtgtaattatgttcatag

SEQ ID NO: 562412 - DNA, 22 bp, Homo sapiens
ggactctagacattcaggacag

SEQ ID NO: 562413 - DNA, 22 bp, Homo sapiens
tgtaccctggagaggtcccccc

SEQ ID NO: 562414 - DNA, 22 bp, Homo sapiens
aggagaagaagatgtgcgcgga

SEQ ID NO: 562415 - DNA, 22 bp, Homo sapiens
tgggcttagagaagttttcagc

SEQ ID NO: 562416 - DNA, 22 bp, Homo sapiens
ttgggacttgtacctttgcttt

SEQ ID NO: 562417 - DNA, 22 bp, Homo sapiens
gattcctgcagaatcacgcagc

SEQ ID NO: 562418 - DNA, 22 bp, Homo sapiens
ttttgttttgttctgtttccct

SEQ ID NO: 562419 - DNA, 22 bp, Homo sapiens
gctcatcccactcccaaaccca

SEQ ID NO: 562420 - DNA, 22 bp, Homo sapiens
tcgaggctgggcagtcaggggg

SEQ ID NO: 562421 - DNA, 22 bp, Homo sapiens
tgggtgtattttattcctcagg

SEQ ID NO: 562422 - DNA, 22 bp, Homo sapiens
taggcacactaggatgagttgg

SEQ ID NO: 562423 - DNA, 22 bp, Homo sapiens
tgagttaaatgagatgccggtg

SEQ ID NO: 562424 - DNA, 22 bp, Homo sapiens
aatgagcagtgggtgggtgagg

SEQ ID NO: 562425 - DNA, 22 bp, Homo sapiens
gcctgggaagagttgaggggag

SEQ ID NO: 562426 - DNA, 22 bp, Homo sapiens
ttctttgaggcaaatattgacc

SEQ ID NO: 562427 - DNA, 22 bp, Homo sapiens
ttgggggaatgagcaatatgtg

SEQ ID NO: 562428 - DNA, 22 bp, Homo sapiens
ggtggctggtactgacggaggg

SEQ ID NO: 562429 - DNA, 22 bp, Homo sapiens
ggattatggagaggagagatgt

SEQ ID NO: 562430 - DNA, 22 bp, Homo sapiens
cagctggtggggagggtgtcct

SEQ ID NO: 562431 - DNA, 22 bp, Homo sapiens
gcaatggcgagggaggggagag

SEQ ID NO: 562432 - DNA, 22 bp, Homo sapiens
tccagaagcctgcctcagatgc

SEQ ID NO: 562433 - DNA, 22 bp, Homo sapiens
ttgtgtccttccagggaagtca

SEQ ID NO: 562434 - DNA, 22 bp, Homo sapiens
tgctctcactggttactcatct

SEQ ID NO: 562435 - DNA, 22 bp, Homo sapiens
tagtgctgtgtatctggagttg

SEQ ID NO: 562436 - DNA, 22 bp, Homo sapiens
tgtagatagcccatgaacttcc

SEQ ID NO: 562437 - DNA, 22 bp, Homo sapiens
gggcctcctggtgcttccgttg

SEQ ID NO: 562438 - DNA, 22 bp, Homo sapiens
tctttctgatttctttgtcatt

SEQ ID NO: 562439 - DNA, 22 bp, Homo sapiens
cacggatcagggagggagggtg

SEQ ID NO: 562440 - DNA, 22 bp, Homo sapiens
ggcagcaaagagtcctcagttt

SEQ ID NO: 562441 - DNA, 22 bp, Homo sapiens
gcttttgatatcctcaggtaga

SEQ ID NO: 562442 - DNA, 22 bp, Homo sapiens
gaggtggctttgggatgtgcca

SEQ ID NO: 562443 - DNA, 22 bp, Homo sapiens
tcccagcagtgccatctggttg

SEQ ID NO: 562444 - DNA, 22 bp, Homo sapiens
gactgtttttgaaaagttgagt

SEQ ID NO: 562445 - DNA, 22 bp, Homo sapiens
cctgcgggagaggaggctggct

SEQ ID NO: 562446 - DNA, 22 bp, Homo sapiens
ctgggtgacctcaggtaagtcc

SEQ ID NO: 562447 - DNA, 22 bp, Homo sapiens
ttgagctaacagggggctctag

SEQ ID NO: 562448 - DNA, 22 bp, Homo sapiens
cggcttctcggacggctggttt

SEQ ID NO: 562449 - DNA, 22 bp, Homo sapiens
tgtccccttccaatcatagctc

SEQ ID NO: 562450 - DNA, 22 bp, Homo sapiens
tgatgctcacaggtgcccggca

SEQ ID NO: 562451 - DNA, 22 bp, Homo sapiens
atggttgggaggcagagagggc

SEQ ID NO: 562452 - DNA, 22 bp, Homo sapiens
tcaggtaacagctatgtctctc

SEQ ID NO: 562453 - DNA, 22 bp, Homo sapiens
agcatttatttgaggcaggaag

SEQ ID NO: 562454 - DNA, 22 bp, Homo sapiens
cctgatctagaatcaataaatg

SEQ ID NO: 562455 - DNA, 22 bp, Homo sapiens
tatttgtaaggcagggccagta

SEQ ID NO: 562456 - DNA, 22 bp, Homo sapiens
tctgggtcccaggcctgatggt

SEQ ID NO: 562457 - DNA, 22 bp, Homo sapiens
ctgctggtgaatagagaagcct

SEQ ID NO: 562458 - DNA, 22 bp, Homo sapiens
tgtggtaggtgtcaggaaagag

SEQ ID NO: 562459 - DNA, 22 bp, Homo sapiens
tgtcaggggcggccttgccgcc

SEQ ID NO: 562460 - DNA, 22 bp, Homo sapiens
tgggagggggctgcgctgcagc

SEQ ID NO: 562461 - DNA, 22 bp, Homo sapiens
agtcagtctcattactttctac

SEQ ID NO: 562462 - DNA, 22 bp, Homo sapiens
ctgctgttactgacctagtttg

SEQ ID NO: 562463 - DNA, 22 bp, Homo sapiens
cccaggtactccgggcctggtc

SEQ ID NO: 562464 - DNA, 22 bp, Homo sapiens
tcattcctgccccgcctctcac

SEQ ID NO: 562465 - DNA, 22 bp, Homo sapiens
agaagtaggtgagctcgggcct

SEQ ID NO: 562466 - DNA, 22 bp, Homo sapiens
tacatggaccaggcatagtgag

SEQ ID NO: 562467 - DNA, 22 bp, Homo sapiens
tccctctgttcctgccaatttg

SEQ ID NO: 562468 - DNA, 22 bp, Homo sapiens
cccccacccctttctcctccaa

SEQ ID NO: 562469 - DNA, 22 bp, Homo sapiens
aaccttctgtatcctttatttt

SEQ ID NO: 562470 - DNA, 22 bp, Homo sapiens
tgggaggggcagggatagaagc

SEQ ID NO: 562471 - DNA, 22 bp, Homo sapiens
ctaattggcaaaagcaggacaa

SEQ ID NO: 562472 - DNA, 22 bp, Homo sapiens
tctccctatcacggaatcattg

SEQ ID NO: 562473 - DNA, 22 bp, Homo sapiens
cttattactataataaccattt

SEQ ID NO: 562474 - DNA, 22 bp, Homo sapiens
ggttgggcgtggccgcaggggc

SEQ ID NO: 562475 - DNA, 22 bp, Homo sapiens
tccctgtggaggaccccttacc

SEQ ID NO: 562476 - DNA, 22 bp, Homo sapiens
ggaaggctgggggcagggacgt

SEQ ID NO: 562477 - DNA, 22 bp, Homo sapiens
tggcctgcattttttttcatgc

SEQ ID NO: 562478 - DNA, 22 bp, Homo sapiens
taaagggtgagctggaaggctc

SEQ ID NO: 562479 - DNA, 22 bp, Homo sapiens
tcttcctgaccgaccagttgtt

SEQ ID NO: 562480 - DNA, 22 bp, Homo sapiens
aggatgcatcagactgtcagca

SEQ ID NO: 562481 - DNA, 22 bp, Homo sapiens
ggataagtgtgcctggctgttc

SEQ ID NO: 562482 - DNA, 22 bp, Homo sapiens
tcttggctgtcctctgtccctt

SEQ ID NO: 562483 - DNA, 22 bp, Homo sapiens
ggtgctcaaataagacttgttg

SEQ ID NO: 562484 - DNA, 22 bp, Homo sapiens
gcacaaaggcagtgctaattac

SEQ ID NO: 562485 - DNA, 22 bp, Homo sapiens
cccctgagggaaggaatagaat

SEQ ID NO: 562486 - DNA, 22 bp, Homo sapiens
agattctcaacttacgtaattc

SEQ ID NO: 562487 - DNA, 22 bp, Homo sapiens
tcccttctggaaaactcagcaa

SEQ ID NO: 562488 - DNA, 22 bp, Homo sapiens
tcattattcctagtgcttacga

SEQ ID NO: 562489 - DNA, 22 bp, Homo sapiens
ctgatggatggacaggggtagt

SEQ ID NO: 562490 - DNA, 22 bp, Homo sapiens
ggaggggcagcctcagggatct

SEQ ID NO: 562491 - DNA, 22 bp, Homo sapiens
caaatctgtatgcccagaccag

SEQ ID NO: 562492 - DNA, 22 bp, Homo sapiens
acttgctcaaggtctcacatag

SEQ ID NO: 562493 - DNA, 22 bp, Homo sapiens
tgcgtattcaggcaggaagaca

SEQ ID NO: 562494 - DNA, 22 bp, Homo sapiens
tggggagagctgagggagctgt

SEQ ID NO: 562495 - DNA, 22 bp, Homo sapiens
ttgttctcatctttcttctttt

SEQ ID NO: 562496 - DNA, 22 bp, Homo sapiens
tgcctagtaccttcttttcttc

SEQ ID NO: 562497 - DNA, 22 bp, Homo sapiens
gagaggtgggggcgatggggtt

SEQ ID NO: 562498 - DNA, 22 bp, Homo sapiens
cgcttccccgcctcccctctgc

SEQ ID NO: 562499 - DNA, 22 bp, Homo sapiens
gagaatggggcctcttagactc

SEQ ID NO: 562500 - DNA, 22 bp, Homo sapiens
gggtccccaccttctggagctt

SEQ ID NO: 562501 - DNA, 22 bp, Homo sapiens
tcagcaaacatttattgtgtgc

SEQ ID NO: 562502 - DNA, 22 bp, Homo sapiens
tggcaaattatagaattgcagc

SEQ ID NO: 562503 - DNA, 22 bp, Homo sapiens
agaggttatccgtgttatgttc

SEQ ID NO: 562504 - DNA, 22 bp, Homo sapiens
tcttcttcactactctagatgt

SEQ ID NO: 562505 - DNA, 22 bp, Homo sapiens
tgattgacacttctgtgagtag

SEQ ID NO: 562506 - DNA, 22 bp, Homo sapiens
tcaaggagttgacactttgggg

SEQ ID NO: 562507 - DNA, 22 bp, Homo sapiens
gtgggacttccgttttgtctcc

SEQ ID NO: 562508 - DNA, 22 bp, Homo sapiens
gcacgggagcaccaagagggca

SEQ ID NO: 562509 - DNA, 22 bp, Homo sapiens
tggggttgagtcaaggcagagc

SEQ ID NO: 562510 - DNA, 22 bp, Homo sapiens
tcactaaatcatatgggactaa

SEQ ID NO: 562511 - DNA, 22 bp, Homo sapiens
catcctgactcatgtcccctgc

SEQ ID NO: 562512 - DNA, 22 bp, Homo sapiens
tgtgtggggttatgtgtgtgtg

SEQ ID NO: 562513 - DNA, 22 bp, Homo sapiens
tagtttttcaagtatttggggc

SEQ ID NO: 562514 - DNA, 22 bp, Homo sapiens
tggtgggaagagcttggacttt

SEQ ID NO: 562515 - DNA, 22 bp, Homo sapiens
cgggtgtgtgcccggccccagg

SEQ ID NO: 562516 - DNA, 22 bp, Homo sapiens
ctgagttttgcaaagcccacac

SEQ ID NO: 562517 - DNA, 22 bp, Homo sapiens
agagaaatggccccagctgagg

SEQ ID NO: 562518 - DNA, 22 bp, Homo sapiens
tctggaggcaattgggactata

SEQ ID NO: 562519 - DNA, 22 bp, Homo sapiens
gatttggggagcagaactggtt

SEQ ID NO: 562520 - DNA, 22 bp, Homo sapiens
tgctagaaggtggggcagggat

SEQ ID NO: 562521 - DNA, 22 bp, Homo sapiens
agcacataggttgtttggcaag

SEQ ID NO: 562522 - DNA, 22 bp, Homo sapiens
tggcagtgtattgttagctggt

SEQ ID NO: 562523 - DNA, 22 bp, Homo sapiens
tctcaaatgatgagtaggtgtt

SEQ ID NO: 562524 - DNA, 22 bp, Homo sapiens
tcttcaaggcaatttgttttaa

SEQ ID NO: 562525 - DNA, 22 bp, Homo sapiens
gggaggagggtccgggccaggt

SEQ ID NO: 562526 - DNA, 22 bp, Homo sapiens
gagcagctgtggcaattcaaat

SEQ ID NO: 562527 - DNA, 22 bp, Homo sapiens
gaggtggctggattttggccta

SEQ ID NO: 562528 - DNA, 22 bp, Homo sapiens
tgggcttcgtggggatcaagct

SEQ ID NO: 562529 - DNA, 22 bp, Homo sapiens
tgttggcgtgcgaggcctcctg

SEQ ID NO: 562530 - DNA, 22 bp, Homo sapiens
ggctgttcctggggcaagggag

SEQ ID NO: 562531 - DNA, 22 bp, Homo sapiens
gaagaaggagcggcccttgtga

SEQ ID NO: 562532 - DNA, 22 bp, Homo sapiens
tgattttggtacccacctcctc

SEQ ID NO: 562533 - DNA, 22 bp, Homo sapiens
ggacaccagcggcggcagcccg

SEQ ID NO: 562534 - DNA, 22 bp, Homo sapiens
tttgaaatttaaatgtatgttt

SEQ ID NO: 562535 - DNA, 22 bp, Homo sapiens
tggtggcagagctgggatttga

SEQ ID NO: 562536 - DNA, 22 bp, Homo sapiens
tgataaagggctctctcagttc

SEQ ID NO: 562537 - DNA, 22 bp, Homo sapiens
tccagagctttcgtacagttta

SEQ ID NO: 562538 - DNA, 22 bp, Homo sapiens
gcttcaccaagtgcttcagttt

SEQ ID NO: 562539 - DNA, 22 bp, Homo sapiens
ttgttctgatttgtgctgggca

SEQ ID NO: 562540 - DNA, 22 bp, Homo sapiens
gttcctctagtgcctgagggga

SEQ ID NO: 562541 - DNA, 22 bp, Homo sapiens
cccgatttgatcccgggatctc

SEQ ID NO: 562542 - DNA, 22 bp, Homo sapiens
atcacaaatttctctagatatt

SEQ ID NO: 562543 - DNA, 22 bp, Homo sapiens
agctgagtcagtatggaaaatt

SEQ ID NO: 562544 - DNA, 22 bp, Homo sapiens
ggaggtagcagcgttggcggtc

SEQ ID NO: 562545 - DNA, 22 bp, Homo sapiens
taacggtgtctagaggaaggga

SEQ ID NO: 562546 - DNA, 22 bp, Homo sapiens
tgattccactttttccccagag

SEQ ID NO: 562547 - DNA, 22 bp, Homo sapiens
ttgatagtctcctagcctgtga

SEQ ID NO: 562548 - DNA, 22 bp, Homo sapiens
ttcagagatttgagtttaagaa

SEQ ID NO: 562549 - DNA, 22 bp, Homo sapiens
gcttattggcagttgtcaaggt

SEQ ID NO: 562550 - DNA, 22 bp, Homo sapiens
gtaagatccagggaaaaggagg

SEQ ID NO: 562551 - DNA, 22 bp, Homo sapiens
tttctagatggactttcaagtc

SEQ ID NO: 562552 - DNA, 22 bp, Homo sapiens
ttctcttagagggtgtagagtt

SEQ ID NO: 562553 - DNA, 22 bp, Homo sapiens
attgtctctgacaaggacactc

SEQ ID NO: 562554 - DNA, 22 bp, Homo sapiens
aaccccagatggcctgtgaatt

SEQ ID NO: 562555 - DNA, 22 bp, Homo sapiens
agaggaatgataaatggcaagg

SEQ ID NO: 562556 - DNA, 22 bp, Homo sapiens
ctaaatgtattttaagtgggct

SEQ ID NO: 562557 - DNA, 22 bp, Homo sapiens
gagccaagggcccttatggagg

SEQ ID NO: 562558 - DNA, 22 bp, Homo sapiens
gccaagaagagggaacgcaggg

SEQ ID NO: 562559 - DNA, 22 bp, Homo sapiens
tggctctgacgccagtgtccta

SEQ ID NO: 562560 - DNA, 22 bp, Homo sapiens
aatgggagtcttaattcttcat

SEQ ID NO: 562561 - DNA, 22 bp, Homo sapiens
tgtgaaactttggggatctacg

SEQ ID NO: 562562 - DNA, 22 bp, Homo sapiens
gcaagggatgggcgggctgctt

SEQ ID NO: 562563 - DNA, 22 bp, Homo sapiens
agtgagatgcctcactcgctct

SEQ ID NO: 562564 - DNA, 22 bp, Homo sapiens
agcactgatattaacatattat

SEQ ID NO: 562565 - DNA, 22 bp, Homo sapiens
gggatggggaagagaggaagag

SEQ ID NO: 562566 - DNA, 22 bp, Homo sapiens
ggaggctgttgtggagagggcc

SEQ ID NO: 562567 - DNA, 22 bp, Homo sapiens
ggagggggtgtgctctgcagag

SEQ ID NO: 562568 - DNA, 22 bp, Homo sapiens
ctcagtttcctcagctgcaaaa

SEQ ID NO: 562569 - DNA, 22 bp, Homo sapiens
taaattggctacttctgtttgg

SEQ ID NO: 562570 - DNA, 22 bp, Homo sapiens
tgtatatgcagtgagtctttct

SEQ ID NO: 562571 - DNA, 22 bp, Homo sapiens
ttgggaggaggagttgataggt

SEQ ID NO: 562572 - DNA, 22 bp, Homo sapiens
tgtagaatctcatctgacgtga

SEQ ID NO: 562573 - DNA, 22 bp, Homo sapiens
gcagagcctgtctccagggact

SEQ ID NO: 562574 - DNA, 22 bp, Homo sapiens
gcatgatatttaaagatttttg

SEQ ID NO: 562575 - DNA, 22 bp, Homo sapiens
gtgagagtccttggggttcttt

SEQ ID NO: 562576 - DNA, 22 bp, Homo sapiens
tcttcctaatggatgcctacaa

SEQ ID NO: 562577 - DNA, 22 bp, Homo sapiens
cctgtgctgtcggtatctcctt

SEQ ID NO: 562578 - DNA, 22 bp, Homo sapiens
ttggcaggatatgcaccagctg

SEQ ID NO: 562579 - DNA, 22 bp, Homo sapiens
tcctggtgggaaattatctcct

SEQ ID NO: 562580 - DNA, 22 bp, Homo sapiens
ggagtgtgattatcccatgata

SEQ ID NO: 562581 - DNA, 22 bp, Homo sapiens
tggagtgatctggaccaggatt

SEQ ID NO: 562582 - DNA, 22 bp, Homo sapiens
tgggatggcaaagtcatcttca

SEQ ID NO: 562583 - DNA, 22 bp, Homo sapiens
tgctcagcgcgccgctcgtggc

SEQ ID NO: 562584 - DNA, 22 bp, Homo sapiens
ttttcaatcagctcaatggaat

SEQ ID NO: 562585 - DNA, 22 bp, Homo sapiens
gcttcctgggacactgcctgaa

SEQ ID NO: 562586 - DNA, 22 bp, Homo sapiens
agccttccaggagaaatggaga

SEQ ID NO: 562587 - DNA, 22 bp, Homo sapiens
tgacactctgaggatgtggttt

SEQ ID NO: 562588 - DNA, 22 bp, Homo sapiens
aggtcttggaagatgttgcacc

SEQ ID NO: 562589 - DNA, 22 bp, Homo sapiens
ggctggtttgtatacagcacac

SEQ ID NO: 562590 - DNA, 22 bp, Homo sapiens
cctgcccagccctcctgctctg

SEQ ID NO: 562591 - DNA, 22 bp, Homo sapiens
ccccctttttaactcatgttgt

SEQ ID NO: 562592 - DNA, 22 bp, Homo sapiens
taggtggttccccacgggggca

SEQ ID NO: 562593 - DNA, 22 bp, Homo sapiens
acagggaatcaggtgtctgcag

SEQ ID NO: 562594 - DNA, 22 bp, Homo sapiens
tgggtaatggaggcggtgactg

SEQ ID NO: 562595 - DNA, 22 bp, Homo sapiens
tgtccccctttaccacctcgta

SEQ ID NO: 562596 - DNA, 22 bp, Homo sapiens
tttagcgaggccttgatccaga

SEQ ID NO: 562597 - DNA, 22 bp, Homo sapiens
tgagccagaatgagatttcagg

SEQ ID NO: 562598 - DNA, 22 bp, Homo sapiens
caaagcaaggctcagtttgaac

SEQ ID NO: 562599 - DNA, 22 bp, Homo sapiens
gcaggcctgggacctgctcttt

SEQ ID NO: 562600 - DNA, 22 bp, Homo sapiens
ggcgtcgcttggctcctcactc

SEQ ID NO: 562601 - DNA, 22 bp, Homo sapiens
tgagtaccgccatgtctgttgg

SEQ ID NO: 562602 - DNA, 22 bp, Homo sapiens
gggtgggggactggtgaaggag

SEQ ID NO: 562603 - DNA, 22 bp, Homo sapiens
catagaaatccctgagagcccc

SEQ ID NO: 562604 - DNA, 22 bp, Homo sapiens
tctccggggaggcaggaatgtg

SEQ ID NO: 562605 - DNA, 22 bp, Homo sapiens
actgggggtccgaaggcagggc

SEQ ID NO: 562606 - DNA, 22 bp, Homo sapiens
tcccgccctccgctcatgctca

SEQ ID NO: 562607 - DNA, 22 bp, Homo sapiens
tagagcaatgtgtaggagaggc

SEQ ID NO: 562608 - DNA, 22 bp, Homo sapiens
agaaaaatcatctctgacattt

SEQ ID NO: 562609 - DNA, 22 bp, Homo sapiens
tgtggtatatacgcacacacgc

SEQ ID NO: 562610 - DNA, 22 bp, Homo sapiens
ataacacaggtagaagtagaca

SEQ ID NO: 562611 - DNA, 22 bp, Homo sapiens
ggaggaggacaagtgagcacct

SEQ ID NO: 562612 - DNA, 22 bp, Homo sapiens
cctgagcaggggtctgggcaga

SEQ ID NO: 562613 - DNA, 22 bp, Homo sapiens
aatggggcccagagctctcaag

SEQ ID NO: 562614 - DNA, 22 bp, Homo sapiens
tcctctcttcccccagcctatc

SEQ ID NO: 562615 - DNA, 22 bp, Homo sapiens
tttggattgatgactggctggg

SEQ ID NO: 562616 - DNA, 22 bp, Homo sapiens
tttggggaattctgcagttgaa

SEQ ID NO: 562617 - DNA, 22 bp, Homo sapiens
cctgtcctgggcgctgggccac

SEQ ID NO: 562618 - DNA, 22 bp, Homo sapiens
tagaatgaggacatagcttttt

SEQ ID NO: 562619 - DNA, 22 bp, Homo sapiens
agtggaaaaattcagtcagttg

SEQ ID NO: 562620 - DNA, 22 bp, Homo sapiens
ttggggcagatcctagaagctg

SEQ ID NO: 562621 - DNA, 22 bp, Homo sapiens
tggcttgagaggtaattatttt

SEQ ID NO: 562622 - DNA, 22 bp, Homo sapiens
tgggtgtaccgggctctgggag

SEQ ID NO: 562623 - DNA, 22 bp, Homo sapiens
tggacgaagcttttctcacagt

SEQ ID NO: 562624 - DNA, 22 bp, Homo sapiens
acccccagctagattgtaagct

SEQ ID NO: 562625 - DNA, 22 bp, Homo sapiens
ccagaatcccatgatgaaatta

SEQ ID NO: 562626 - DNA, 22 bp, Homo sapiens
aggaggcctgggatgagcagga

SEQ ID NO: 562627 - DNA, 22 bp, Homo sapiens
aggctggacactgggggctcgt

SEQ ID NO: 562628 - DNA, 22 bp, Homo sapiens
tccccctggttgctatgttggg

SEQ ID NO: 562629 - DNA, 22 bp, Homo sapiens
ttgggtctacagagcctaaagt

SEQ ID NO: 562630 - DNA, 22 bp, Homo sapiens
attgttccaggtgctgtggatt

SEQ ID NO: 562631 - DNA, 22 bp, Homo sapiens
ggaaggttatcagagggagaag

SEQ ID NO: 562632 - DNA, 22 bp, Homo sapiens
aactttgggttactatggcaat

SEQ ID NO: 562633 - DNA, 22 bp, Homo sapiens
tagttaatatagcttcacctaa

SEQ ID NO: 562634 - DNA, 22 bp, Homo sapiens
ccagtactgggccaggcctacc

SEQ ID NO: 562635 - DNA, 22 bp, Homo sapiens
tctgatgaccttgttttattga

SEQ ID NO: 562636 - DNA, 22 bp, Homo sapiens
aatagacatggacaattgtcca

SEQ ID NO: 562637 - DNA, 22 bp, Homo sapiens
cgccgggggtcaatctgcagcg

SEQ ID NO: 562638 - DNA, 22 bp, Homo sapiens
tgctttcaccaaggtgcctctg

SEQ ID NO: 562639 - DNA, 22 bp, Homo sapiens
tattagaaatataagaatgtgg

SEQ ID NO: 562640 - DNA, 22 bp, Homo sapiens
taagtgcactgtaagtgcagga

SEQ ID NO: 562641 - DNA, 22 bp, Homo sapiens
caagataggagagggcagtgct

SEQ ID NO: 562642 - DNA, 22 bp, Homo sapiens
tccataacccatgtatggcttt

SEQ ID NO: 562643 - DNA, 22 bp, Homo sapiens
ttgcattgtggttgcagtcaat

SEQ ID NO: 562644 - DNA, 22 bp, Homo sapiens
tccactggtgggctgtttattt

SEQ ID NO: 562645 - DNA, 22 bp, Homo sapiens
tgggtgaggcattttatttgtt

SEQ ID NO: 562646 - DNA, 22 bp, Homo sapiens
gggccctatattaatggaccaa

SEQ ID NO: 562647 - DNA, 22 bp, Homo sapiens
atgggtagaggcctcctgagtt

SEQ ID NO: 562648 - DNA, 22 bp, Homo sapiens
ttggctgacacattagtttatt

SEQ ID NO: 562649 - DNA, 22 bp, Homo sapiens
aggccatctgcagagaagaaag

SEQ ID NO: 562650 - DNA, 22 bp, Homo sapiens
aggccaggccctcaggcaaggg

SEQ ID NO: 562651 - DNA, 22 bp, Homo sapiens
tgcccgaggggctgctgggcag

SEQ ID NO: 562652 - DNA, 22 bp, Homo sapiens
tagcatggggattatgccagaa

SEQ ID NO: 562653 - DNA, 22 bp, Homo sapiens
gctcaagtggccagcagggcac

SEQ ID NO: 562654 - DNA, 22 bp, Homo sapiens
gtaatttatatgcaaatagcag

SEQ ID NO: 562655 - DNA, 22 bp, Homo sapiens
ggagctggcttgtggaagttgg

SEQ ID NO: 562656 - DNA, 22 bp, Homo sapiens
gggtctgtgtcactgtgggagt

SEQ ID NO: 562657 - DNA, 22 bp, Homo sapiens
gacattattatttttcctactt

SEQ ID NO: 562658 - DNA, 22 bp, Homo sapiens
gaggcaggagcatttcagatgg

SEQ ID NO: 562659 - DNA, 22 bp, Homo sapiens
tcagacctgtctcctcttgcca

SEQ ID NO: 562660 - DNA, 22 bp, Homo sapiens
cccagggtgggatgctgagagg

SEQ ID NO: 562661 - DNA, 22 bp, Homo sapiens
ccttgatttcacacttgggcta

SEQ ID NO: 562662 - DNA, 22 bp, Homo sapiens
tgctgtctttaatctgcctgtg

SEQ ID NO: 562663 - DNA, 22 bp, Homo sapiens
tgctgatactactgctagtact

SEQ ID NO: 562664 - DNA, 22 bp, Homo sapiens
tgggggagcattccctgctcct

SEQ ID NO: 562665 - DNA, 22 bp, Homo sapiens
cctttccacttcccctggttcc

SEQ ID NO: 562666 - DNA, 22 bp, Homo sapiens
tatctctaagcccttggtcaat

SEQ ID NO: 562667 - DNA, 22 bp, Homo sapiens
tccaccctgtcccaggccctgt

SEQ ID NO: 562668 - DNA, 22 bp, Homo sapiens
tgtcacagctggagagtgacct

SEQ ID NO: 562669 - DNA, 22 bp, Homo sapiens
gagcgcgcctccccctcaactc

SEQ ID NO: 562670 - DNA, 22 bp, Homo sapiens
taaagtatttaccaggtttcat

SEQ ID NO: 562671 - DNA, 22 bp, Homo sapiens
ttttacctactagtctcttgta

SEQ ID NO: 562672 - DNA, 22 bp, Homo sapiens
cccatcctcacagtctcagtct

SEQ ID NO: 562673 - DNA, 22 bp, Homo sapiens
tgaggtcatttccatcttccat

SEQ ID NO: 562674 - DNA, 22 bp, Homo sapiens
tacccgctttatctctacccag

SEQ ID NO: 562675 - DNA, 22 bp, Homo sapiens
ccagcttttcaaaatgggtccc

SEQ ID NO: 562676 - DNA, 22 bp, Homo sapiens
tgactgattgcactacatactg

SEQ ID NO: 562677 - DNA, 22 bp, Homo sapiens
taggaaagaatgagggagagga

SEQ ID NO: 562678 - DNA, 22 bp, Homo sapiens
tccatatgtgccttttgagagc

SEQ ID NO: 562679 - DNA, 22 bp, Homo sapiens
tgcttgtggctattcttatgac

SEQ ID NO: 562680 - DNA, 22 bp, Homo sapiens
tcctctgcagtatcctagccac

SEQ ID NO: 562681 - DNA, 22 bp, Homo sapiens
ttttctctcttgcctagctcct

SEQ ID NO: 562682 - DNA, 22 bp, Homo sapiens
gtctggtagccaaatgctgtca

SEQ ID NO: 562683 - DNA, 22 bp, Homo sapiens
aggggtgatgcgcatgattttt

SEQ ID NO: 562684 - DNA, 22 bp, Homo sapiens
gggttggaggccgggctggaca

SEQ ID NO: 562685 - DNA, 22 bp, Homo sapiens
tcacctcattagtatcttgttt

SEQ ID NO: 562686 - DNA, 22 bp, Homo sapiens
ggccgagggggctgggcgggct

SEQ ID NO: 562687 - DNA, 22 bp, Homo sapiens
taccagggaaggccctgggaga

SEQ ID NO: 562688 - DNA, 22 bp, Homo sapiens
ttgcttatgcacttctcctcag

SEQ ID NO: 562689 - DNA, 22 bp, Homo sapiens
ttgacctcccctagacctggct

SEQ ID NO: 562690 - DNA, 22 bp, Homo sapiens
tcctggagccctgcccagccca

SEQ ID NO: 562691 - DNA, 22 bp, Homo sapiens
ggcttttgtggtattaaacacc

SEQ ID NO: 562692 - DNA, 22 bp, Homo sapiens
tggggttcactcctgggaaagg

SEQ ID NO: 562693 - DNA, 22 bp, Homo sapiens
ggagcaggagaccagggaggag

SEQ ID NO: 562694 - DNA, 22 bp, Homo sapiens
tgggtatatttactggtgagtt

SEQ ID NO: 562695 - DNA, 22 bp, Homo sapiens
tcatcggaaatcagatctgatg

SEQ ID NO: 562696 - DNA, 22 bp, Homo sapiens
gctctgtatacagtctgggctt

SEQ ID NO: 562697 - DNA, 22 bp, Homo sapiens
gcaatatttctgaaagctgaga

SEQ ID NO: 562698 - DNA, 22 bp, Homo sapiens
ctgtctagctgtgtggcccggc

SEQ ID NO: 562699 - DNA, 22 bp, Homo sapiens
ttgactttgagtgtgtgtgcct

SEQ ID NO: 562700 - DNA, 22 bp, Homo sapiens
ttacgtaaggaggaagggaaca

SEQ ID NO: 562701 - DNA, 22 bp, Homo sapiens
tgggcaggcttgggacctgcca

SEQ ID NO: 562702 - DNA, 22 bp, Homo sapiens
tgtgaagtttgagatgtctatt

SEQ ID NO: 562703 - DNA, 22 bp, Homo sapiens
ggtgaagaataaggagtggggg

SEQ ID NO: 562704 - DNA, 22 bp, Homo sapiens
cgcagaggggcttgaggccctg

SEQ ID NO: 562705 - DNA, 22 bp, Homo sapiens
ctcttcttgggcctcctgcacc

SEQ ID NO: 562706 - DNA, 22 bp, Homo sapiens
gccagtcctgggggctctatgc

SEQ ID NO: 562707 - DNA, 22 bp, Homo sapiens
aagacggaaatgaggcttgcct

SEQ ID NO: 562708 - DNA, 22 bp, Homo sapiens
aatgggctgtattccaaaaatt

SEQ ID NO: 562709 - DNA, 22 bp, Homo sapiens
tgaggactaaatgaatcatact

SEQ ID NO: 562710 - DNA, 22 bp, Homo sapiens
cagtcaggaagagaagtaaaga

SEQ ID NO: 562711 - DNA, 22 bp, Homo sapiens
ttttcactgggggaaggaaagg

SEQ ID NO: 562712 - DNA, 22 bp, Homo sapiens
tgctgattgtcgttgtcatctg

SEQ ID NO: 562713 - DNA, 22 bp, Homo sapiens
cgtgtgcttctggctcagggcc

SEQ ID NO: 562714 - DNA, 22 bp, Homo sapiens
tccagcgtgtgcagctcctcct

SEQ ID NO: 562715 - DNA, 22 bp, Homo sapiens
tggcaggaagaggacagaaata

SEQ ID NO: 562716 - DNA, 22 bp, Homo sapiens
gtatcgtctcacattcacacca

SEQ ID NO: 562717 - DNA, 22 bp, Homo sapiens
agttgagggtgaaccattttgg

SEQ ID NO: 562718 - DNA, 22 bp, Homo sapiens
tctcctgcttcagctttgtctc

SEQ ID NO: 562719 - DNA, 22 bp, Homo sapiens
gggcttctggtacattcattct

SEQ ID NO: 562720 - DNA, 22 bp, Homo sapiens
ctgggacaggaaggatggagac

SEQ ID NO: 562721 - DNA, 22 bp, Homo sapiens
ttcctcttccacctcctccagc

SEQ ID NO: 562722 - DNA, 22 bp, Homo sapiens
tcttttgttagaatcaaaggca

SEQ ID NO: 562723 - DNA, 22 bp, Homo sapiens
ttgccactatggcctcctccct

SEQ ID NO: 562724 - DNA, 22 bp, Homo sapiens
tacataaaaattccctggtcac

SEQ ID NO: 562725 - DNA, 22 bp, Homo sapiens
tggagtggtctttctctcaact

SEQ ID NO: 562726 - DNA, 22 bp, Homo sapiens
gggagttgggagcagagagggg

SEQ ID NO: 562727 - DNA, 22 bp, Homo sapiens
gctccttttcttggggcctaaa

SEQ ID NO: 562728 - DNA, 22 bp, Homo sapiens
tcaggagggaggggaagaggca

SEQ ID NO: 562729 - DNA, 22 bp, Homo sapiens
tggaggtcccagggtggttggg

SEQ ID NO: 562730 - DNA, 22 bp, Homo sapiens
ccctgtggggtccgcctgtccg

SEQ ID NO: 562731 - DNA, 22 bp, Homo sapiens
gctaaagcatctgcagcatctt

SEQ ID NO: 562732 - DNA, 22 bp, Homo sapiens
tccaccatgtggctcagcaaca

SEQ ID NO: 562733 - DNA, 22 bp, Homo sapiens
ttgcttgatgattcatagtaag

SEQ ID NO: 562734 - DNA, 22 bp, Homo sapiens
ctgcagaccccaatcttcttgg

SEQ ID NO: 562735 - DNA, 22 bp, Homo sapiens
gggagcttagtgtacttccgct

SEQ ID NO: 562736 - DNA, 22 bp, Homo sapiens
tgccaggcctttgtcctggcgt

SEQ ID NO: 562737 - DNA, 22 bp, Homo sapiens
aggcgcgagggccgggggtcgt

SEQ ID NO: 562738 - DNA, 22 bp, Homo sapiens
gggtgggtgccagggtggggca

SEQ ID NO: 562739 - DNA, 22 bp, Homo sapiens
ttattgaaattttgatgtagat

SEQ ID NO: 562740 - DNA, 22 bp, Homo sapiens
tagacaattccatcctacgtgg

SEQ ID NO: 562741 - DNA, 22 bp, Homo sapiens
tataagcagagctctccccttt

SEQ ID NO: 562742 - DNA, 22 bp, Homo sapiens
tttcagcattgctaatccacat

SEQ ID NO: 562743 - DNA, 22 bp, Homo sapiens
catttctcctggaaggcttgag

SEQ ID NO: 562744 - DNA, 22 bp, Homo sapiens
gctaaaaattgcgttctgctgt

SEQ ID NO: 562745 - DNA, 22 bp, Homo sapiens
taggctttaacatcagacaggt

SEQ ID NO: 562746 - DNA, 22 bp, Homo sapiens
catcacaggcacctgtctcctt

SEQ ID NO: 562747 - DNA, 22 bp, Homo sapiens
agtagtgcaatattgcttatag

SEQ ID NO: 562748 - DNA, 22 bp, Homo sapiens
ttctggggtgggagccagggcg

SEQ ID NO: 562749 - DNA, 22 bp, Homo sapiens
tctgtggcctcttagacactga

SEQ ID NO: 562750 - DNA, 22 bp, Homo sapiens
ggatcctgtaagggctgagcct

SEQ ID NO: 562751 - DNA, 22 bp, Homo sapiens
tccttctggcagcttcttggca

SEQ ID NO: 562752 - DNA, 22 bp, Homo sapiens
cctaagtgaaaaatatgctaag

SEQ ID NO: 562753 - DNA, 22 bp, Homo sapiens
ttttccctggctctctggcttg

SEQ ID NO: 562754 - DNA, 22 bp, Homo sapiens
gaagtggcactctggtggcttt

SEQ ID NO: 562755 - DNA, 22 bp, Homo sapiens
ttcgtccgtgtgagtgtgtccg

SEQ ID NO: 562756 - DNA, 22 bp, Homo sapiens
ctatgcatgtcatatgtgagct

SEQ ID NO: 562757 - DNA, 22 bp, Homo sapiens
agcaagatttctctatttcctg

SEQ ID NO: 562758 - DNA, 22 bp, Homo sapiens
taggcaggtggaggagtgaagg

SEQ ID NO: 562759 - DNA, 22 bp, Homo sapiens
tgattcaacttggcaggagact

SEQ ID NO: 562760 - DNA, 22 bp, Homo sapiens
ggctgaattcgcaggcccaagg

SEQ ID NO: 562761 - DNA, 22 bp, Homo sapiens
ttctaggatttctcaggtgtag

SEQ ID NO: 562762 - DNA, 22 bp, Homo sapiens
gtgtatatatatgtaaactaaa

SEQ ID NO: 562763 - DNA, 22 bp, Homo sapiens
tctgggctggctttgtctcctt

SEQ ID NO: 562764 - DNA, 22 bp, Homo sapiens
atcatacaaggacaatttcttt

SEQ ID NO: 562765 - DNA, 22 bp, Homo sapiens
ccatgttccttgcattgtcatc

SEQ ID NO: 562766 - DNA, 22 bp, Homo sapiens
tgggtttgtgtgagtgcccatg

SEQ ID NO: 562767 - DNA, 22 bp, Homo sapiens
ggaggtgggagagggtctcaga

SEQ ID NO: 562768 - DNA, 22 bp, Homo sapiens
tggtccactaaccctcagtatc

SEQ ID NO: 562769 - DNA, 22 bp, Homo sapiens
acactacccccaggaagtgtca

SEQ ID NO: 562770 - DNA, 22 bp, Homo sapiens
cccctcctttgtctcaggggtg

SEQ ID NO: 562771 - DNA, 22 bp, Homo sapiens
tctgccttccggggacggtagg

SEQ ID NO: 562772 - DNA, 22 bp, Homo sapiens
taaaagctgagacaatgaaagc

SEQ ID NO: 562773 - DNA, 22 bp, Homo sapiens
tggaattgttcctgggctggtg

SEQ ID NO: 562774 - DNA, 22 bp, Homo sapiens
agtgtggtgtaagtaagatctg

SEQ ID NO: 562775 - DNA, 22 bp, Homo sapiens
cccccagctgagggaccagctc

SEQ ID NO: 562776 - DNA, 22 bp, Homo sapiens
gtgctgtttctgatgaatgcca

SEQ ID NO: 562777 - DNA, 22 bp, Homo sapiens
gaggtaggtcttcagtcttgag

SEQ ID NO: 562778 - DNA, 22 bp, Homo sapiens
gatttatgggaaactggcaatt

SEQ ID NO: 562779 - DNA, 22 bp, Homo sapiens
aaggtctaactaaaacactccc

SEQ ID NO: 562780 - DNA, 22 bp, Homo sapiens
ggatgcagggtgtggactcatg

SEQ ID NO: 562781 - DNA, 22 bp, Homo sapiens
aaagttgttaactttacttagg

SEQ ID NO: 562782 - DNA, 22 bp, Homo sapiens
tggtggctgaggcagggggatg

SEQ ID NO: 562783 - DNA, 22 bp, Homo sapiens
tgaggggcagaatgtgatcagg

SEQ ID NO: 562784 - DNA, 22 bp, Homo sapiens
tggctgggtcctgaaagcatgc

SEQ ID NO: 562785 - DNA, 22 bp, Homo sapiens
gaaacagctcagtcacagggtg

SEQ ID NO: 562786 - DNA, 22 bp, Homo sapiens
acatatggctaataacctattg

SEQ ID NO: 562787 - DNA, 22 bp, Homo sapiens
tggagaaggaggtcttggaggc

SEQ ID NO: 562788 - DNA, 22 bp, Homo sapiens
agtgtcatggaccttcctccct

SEQ ID NO: 562789 - DNA, 22 bp, Homo sapiens
ttcgggtgctgtttgcctgtgt

SEQ ID NO: 562790 - DNA, 22 bp, Homo sapiens
gaattatagtgccatttgtttt

SEQ ID NO: 562791 - DNA, 22 bp, Homo sapiens
tgaggagcaaagccctgtgggg

SEQ ID NO: 562792 - DNA, 22 bp, Homo sapiens
aagtgtccttttgggggacctt

SEQ ID NO: 562793 - DNA, 22 bp, Homo sapiens
tgcctatgtgtatcactaatat

SEQ ID NO: 562794 - DNA, 22 bp, Homo sapiens
taagagaaacagtcctaagtga

SEQ ID NO: 562795 - DNA, 22 bp, Homo sapiens
ataacaaacacctgtaaaacag

SEQ ID NO: 562796 - DNA, 22 bp, Homo sapiens
ccccactgtgatttctaggtac

SEQ ID NO: 562797 - DNA, 22 bp, Homo sapiens
atggttcatgcagaggtctggg

SEQ ID NO: 562798 - DNA, 22 bp, Homo sapiens
aatgagggcaggtatcaaccat

SEQ ID NO: 562799 - DNA, 22 bp, Homo sapiens
ctcacaggtgtatggaaaagta

SEQ ID NO: 562800 - DNA, 22 bp, Homo sapiens
ctgcaaactgggatactattca

SEQ ID NO: 562801 - DNA, 22 bp, Homo sapiens
tggtctatcatttgggtgggga

SEQ ID NO: 562802 - DNA, 22 bp, Homo sapiens
agagctgattgatggctttttg

SEQ ID NO: 562803 - DNA, 22 bp, Homo sapiens
gctgcccatggtccaggaagac

SEQ ID NO: 562804 - DNA, 22 bp, Homo sapiens
gtgtggtagcagttgagaggaa

SEQ ID NO: 562805 - DNA, 22 bp, Homo sapiens
tgacaccaaatcattgggatga

SEQ ID NO: 562806 - DNA, 22 bp, Homo sapiens
tgacagtgtctatcttattggt

SEQ ID NO: 562807 - DNA, 22 bp, Homo sapiens
cttccacactgggggcggagcc

SEQ ID NO: 562808 - DNA, 22 bp, Homo sapiens
tctggcagtagatccagtctct

SEQ ID NO: 562809 - DNA, 22 bp, Homo sapiens
taagtagaaatgcagaacctga

SEQ ID NO: 562810 - DNA, 22 bp, Homo sapiens
tgagatttggtggtttacctga

SEQ ID NO: 562811 - DNA, 22 bp, Homo sapiens
gctcgggggatgcagggcccca

SEQ ID NO: 562812 - DNA, 22 bp, Homo sapiens
ttgttggctccatgttttcttt

SEQ ID NO: 562813 - DNA, 22 bp, Homo sapiens
tactcagttcctgccatgccct

SEQ ID NO: 562814 - DNA, 22 bp, Homo sapiens
tatattcacacacgcataggct

SEQ ID NO: 562815 - DNA, 22 bp, Homo sapiens
ccccaggagggcctctctgatt

SEQ ID NO: 562816 - DNA, 22 bp, Homo sapiens
aatttgtttattcttgggagta

SEQ ID NO: 562817 - DNA, 22 bp, Homo sapiens
cccgacagtgcctcctctcctc

SEQ ID NO: 562818 - DNA, 22 bp, Homo sapiens
ggggcgaggggcactgggcaaa

SEQ ID NO: 562819 - DNA, 22 bp, Homo sapiens
tgctgaaccctcgagggtctga

SEQ ID NO: 562820 - DNA, 22 bp, Homo sapiens
aggagcaggagcgtggaccaac

SEQ ID NO: 562821 - DNA, 22 bp, Homo sapiens
tgtctccagaggatgccaagca

SEQ ID NO: 562822 - DNA, 22 bp, Homo sapiens
tccgggctgcctttgcctttaa

SEQ ID NO: 562823 - DNA, 22 bp, Homo sapiens
tctggtagcagatatttcccct

SEQ ID NO: 562824 - DNA, 22 bp, Homo sapiens
tccataataggagaggtgtgga

SEQ ID NO: 562825 - DNA, 22 bp, Homo sapiens
tgggtatcggttggtgcaaaag

SEQ ID NO: 562826 - DNA, 22 bp, Homo sapiens
aaaacagatgggcaatatccag

SEQ ID NO: 562827 - DNA, 22 bp, Homo sapiens
gcctagtaattttcgataaagc

SEQ ID NO: 562828 - DNA, 22 bp, Homo sapiens
tgatatataatgaggtgaggga

SEQ ID NO: 562829 - DNA, 22 bp, Homo sapiens
cctaccccatgtaaccccattt

SEQ ID NO: 562830 - DNA, 22 bp, Homo sapiens
aaggaaaaggcgagaggagagg

SEQ ID NO: 562831 - DNA, 22 bp, Homo sapiens
agggcttggagaatgatggatc

SEQ ID NO: 562832 - DNA, 22 bp, Homo sapiens
tgtattggagttcttctcttct

SEQ ID NO: 562833 - DNA, 22 bp, Homo sapiens
tgtctccagggcaggtgcaggt

SEQ ID NO: 562834 - DNA, 22 bp, Homo sapiens
tacagtaacacataggacatgg

SEQ ID NO: 562835 - DNA, 22 bp, Homo sapiens
acatttgaggagagccctacta

SEQ ID NO: 562836 - DNA, 22 bp, Homo sapiens
aggctgaggcccagagagaggc

SEQ ID NO: 562837 - DNA, 22 bp, Homo sapiens
tgaggtgaggagggttagcctg

SEQ ID NO: 562838 - DNA, 22 bp, Homo sapiens
cccaatatcaaacatatcacac

SEQ ID NO: 562839 - DNA, 22 bp, Homo sapiens
agttcagggagtttacaagtct

SEQ ID NO: 562840 - DNA, 22 bp, Homo sapiens
tgagctctttctcatcaggctc

SEQ ID NO: 562841 - DNA, 22 bp, Homo sapiens
tttaccagtaggtcaattctct

SEQ ID NO: 562842 - DNA, 22 bp, Homo sapiens
agagccaggcgtgaggattccc

SEQ ID NO: 562843 - DNA, 22 bp, Homo sapiens
tggaagggagaaaacttgtggc

SEQ ID NO: 562844 - DNA, 22 bp, Homo sapiens
tgagggatcaggatcttctttc

SEQ ID NO: 562845 - DNA, 22 bp, Homo sapiens
atagcttagagtttgggtcagc

SEQ ID NO: 562846 - DNA, 22 bp, Homo sapiens
gtggaaggaattaaccagtaaa

SEQ ID NO: 562847 - DNA, 22 bp, Homo sapiens
aacttcagaggaactcctggga

SEQ ID NO: 562848 - DNA, 22 bp, Homo sapiens
gcactcagccctggctgttggc

SEQ ID NO: 562849 - DNA, 22 bp, Homo sapiens
cagtccagaggagctgagagta

SEQ ID NO: 562850 - DNA, 22 bp, Homo sapiens
tggagacttctaggaaatcagc

SEQ ID NO: 562851 - DNA, 22 bp, Homo sapiens
tgaatggtcaacatgtattgag

SEQ ID NO: 562852 - DNA, 22 bp, Homo sapiens
tccttccttccttcctggtgct

SEQ ID NO: 562853 - DNA, 22 bp, Homo sapiens
catactcctttttgaaagttgc

SEQ ID NO: 562854 - DNA, 22 bp, Homo sapiens
tgtgggaggaaggagcctggga

SEQ ID NO: 562855 - DNA, 22 bp, Homo sapiens
acaccgcattgaatgtcctaaa

SEQ ID NO: 562856 - DNA, 22 bp, Homo sapiens
tatggtaagactgagtgaatca

SEQ ID NO: 562857 - DNA, 22 bp, Homo sapiens
cctctggggttaatagagttta

SEQ ID NO: 562858 - DNA, 22 bp, Homo sapiens
tgtctggctgcttgttttgatg

SEQ ID NO: 562859 - DNA, 22 bp, Homo sapiens
tgacctgacagtggcctctggt

SEQ ID NO: 562860 - DNA, 22 bp, Homo sapiens
actgtccttcctggaggtgtgc

SEQ ID NO: 562861 - DNA, 22 bp, Homo sapiens
tatactctcctcattgatttct

SEQ ID NO: 562862 - DNA, 22 bp, Homo sapiens
cgggaagggggagggttggagc

SEQ ID NO: 562863 - DNA, 22 bp, Homo sapiens
taaggcaatggtcctccaatgc

SEQ ID NO: 562864 - DNA, 22 bp, Homo sapiens
tgtcatgcttttgatggcatta

SEQ ID NO: 562865 - DNA, 22 bp, Homo sapiens
agggtgggctggcatggggcat

SEQ ID NO: 562866 - DNA, 22 bp, Homo sapiens
tccaagtgaaaatgttgactgc

SEQ ID NO: 562867 - DNA, 22 bp, Homo sapiens
tacaggtgacgcaggtatccag

SEQ ID NO: 562868 - DNA, 22 bp, Homo sapiens
ttttaatgtatggttctgcaaa

SEQ ID NO: 562869 - DNA, 22 bp, Homo sapiens
ttgtgcaatctgtttggctgct

SEQ ID NO: 562870 - DNA, 22 bp, Homo sapiens
tttctctatctttgaggctgca

SEQ ID NO: 562871 - DNA, 22 bp, Homo sapiens
taggtatgacactccagaggcc

SEQ ID NO: 562872 - DNA, 22 bp, Homo sapiens
gggagttagttaatgaccatcc

SEQ ID NO: 562873 - DNA, 22 bp, Homo sapiens
tctgctcacacttcctccccct

SEQ ID NO: 562874 - DNA, 22 bp, Homo sapiens
tcggccggggcgggcgcgggac

SEQ ID NO: 562875 - DNA, 22 bp, Homo sapiens
ccggtcctcgctctctccccct

SEQ ID NO: 562876 - DNA, 22 bp, Homo sapiens
agagccacgaacagggctgtgc

SEQ ID NO: 562877 - DNA, 22 bp, Homo sapiens
tcttttggggaaatttgggacc

SEQ ID NO: 562878 - DNA, 22 bp, Homo sapiens
tcgtagatgataccaggtgtga

SEQ ID NO: 562879 - DNA, 22 bp, Homo sapiens
tagatgtataaatattaaaaag

SEQ ID NO: 562880 - DNA, 22 bp, Homo sapiens
aaatggtttccttggtgtcaaa

SEQ ID NO: 562881 - DNA, 22 bp, Homo sapiens
tagtgcttctggcatttcagag

SEQ ID NO: 562882 - DNA, 22 bp, Homo sapiens
ttctggttcctctgcctttgtg

SEQ ID NO: 562883 - DNA, 22 bp, Homo sapiens
tacttccaggccaagaagggta

SEQ ID NO: 562884 - DNA, 22 bp, Homo sapiens
gcgcctcccatctgaggtgcgg

SEQ ID NO: 562885 - DNA, 22 bp, Homo sapiens
taatttcctgttaataccaata

SEQ ID NO: 562886 - DNA, 22 bp, Homo sapiens
gggtggacaggtgctaattcct

SEQ ID NO: 562887 - DNA, 22 bp, Homo sapiens
gggtgagtcctctccagggatg

SEQ ID NO: 562888 - DNA, 22 bp, Homo sapiens
tgagtccagtcctggcctctgc

SEQ ID NO: 562889 - DNA, 22 bp, Homo sapiens
aaggtcctggagtgggccatag

SEQ ID NO: 562890 - DNA, 22 bp, Homo sapiens
ggctggggagggaaagggatac

SEQ ID NO: 562891 - DNA, 22 bp, Homo sapiens
cccggttttcccagcacctcct

SEQ ID NO: 562892 - DNA, 22 bp, Homo sapiens
tctctctgttggcttctgtgct

SEQ ID NO: 562893 - DNA, 22 bp, Homo sapiens
aaaggtggggagctggggaaga

SEQ ID NO: 562894 - DNA, 22 bp, Homo sapiens
tctagaataaacctaaattttt

SEQ ID NO: 562895 - DNA, 22 bp, Homo sapiens
tacacatatcaggtgtatacat

SEQ ID NO: 562896 - DNA, 22 bp, Homo sapiens
cggtgggagtaaggggagtgtg

SEQ ID NO: 562897 - DNA, 22 bp, Homo sapiens
agctggcagctctcaggggtac

SEQ ID NO: 562898 - DNA, 22 bp, Homo sapiens
ttaagaactctaggttcctgga

SEQ ID NO: 562899 - DNA, 22 bp, Homo sapiens
cctgtcttctctgtgggatcca

SEQ ID NO: 562900 - DNA, 22 bp, Homo sapiens
aaacctactttctttttagatt

SEQ ID NO: 562901 - DNA, 22 bp, Homo sapiens
tgaatgctggggcaataggatg

SEQ ID NO: 562902 - DNA, 22 bp, Homo sapiens
tattccctccacattggtcagc

SEQ ID NO: 562903 - DNA, 22 bp, Homo sapiens
tccccctcagtgcttcagtaac

SEQ ID NO: 562904 - DNA, 22 bp, Homo sapiens
aactggccctcaaagtcccgct

SEQ ID NO: 562905 - DNA, 22 bp, Homo sapiens
acttggtccttgggcactattg

SEQ ID NO: 562906 - DNA, 22 bp, Homo sapiens
taaaatctcccaactctggccg

SEQ ID NO: 562907 - DNA, 22 bp, Homo sapiens
tgagcgcttttctctggctcat

SEQ ID NO: 562908 - DNA, 22 bp, Homo sapiens
tggatctctggacttctgtctg

SEQ ID NO: 562909 - DNA, 22 bp, Homo sapiens
gctatcaactcccccagctggt

SEQ ID NO: 562910 - DNA, 22 bp, Homo sapiens
tgaatctcaggctgtgaagtcc

SEQ ID NO: 562911 - DNA, 22 bp, Homo sapiens
tctctgcaggcgggcttcgccc

SEQ ID NO: 562912 - DNA, 22 bp, Homo sapiens
caatcagagagcagcttttatg

SEQ ID NO: 562913 - DNA, 22 bp, Homo sapiens
attgggagtttggtggatacgt

SEQ ID NO: 562914 - DNA, 22 bp, Homo sapiens
tttttggagcatttttaattta

SEQ ID NO: 562915 - DNA, 22 bp, Homo sapiens
tgagcaggcgggaggcctggca

SEQ ID NO: 562916 - DNA, 22 bp, Homo sapiens
ttgagggaagcatttctcccta

SEQ ID NO: 562917 - DNA, 22 bp, Homo sapiens
tcaggtattctggaacagagaa

SEQ ID NO: 562918 - DNA, 22 bp, Homo sapiens
taacaaatttaaaaaaaactaa

SEQ ID NO: 562919 - DNA, 22 bp, Homo sapiens
ctaattgtgctgttctgggtca

SEQ ID NO: 562920 - DNA, 22 bp, Homo sapiens
tcaaattaaatcaagactattt

SEQ ID NO: 562921 - DNA, 22 bp, Homo sapiens
ttttttgggtctgtttgattgc

SEQ ID NO: 562922 - DNA, 22 bp, Homo sapiens
ttaagtagaaccctgcccatca

SEQ ID NO: 562923 - DNA, 22 bp, Homo sapiens
agtcaggagccacgtggaagag

SEQ ID NO: 562924 - DNA, 22 bp, Homo sapiens
tctgtgtagattctgtaaatcc

SEQ ID NO: 562925 - DNA, 22 bp, Homo sapiens
aggtggcacctagctgctattt

SEQ ID NO: 562926 - DNA, 22 bp, Homo sapiens
aaggtcaaccagtcctcatggt

SEQ ID NO: 562927 - DNA, 22 bp, Homo sapiens
ggcaagggttggactctgtggc

SEQ ID NO: 562928 - DNA, 22 bp, Homo sapiens
ttttggcatgtggcctctgggt

SEQ ID NO: 562929 - DNA, 22 bp, Homo sapiens
tgcaggctgattgcagcagatt

SEQ ID NO: 562930 - DNA, 22 bp, Homo sapiens
ggatcccctaagacccttcctt

SEQ ID NO: 562931 - DNA, 22 bp, Homo sapiens
cagggcccttgactcaagtgcc

SEQ ID NO: 562932 - DNA, 22 bp, Homo sapiens
tccctctctccactgaacactc

SEQ ID NO: 562933 - DNA, 22 bp, Homo sapiens
tgcccacatcccatcacagggc

SEQ ID NO: 562934 - DNA, 22 bp, Homo sapiens
aaaggaggaaagccagggtgtt

SEQ ID NO: 562935 - DNA, 22 bp, Homo sapiens
aacaggggctcacagtaatgct

SEQ ID NO: 562936 - DNA, 22 bp, Homo sapiens
ttccctgccactcagctcctga

SEQ ID NO: 562937 - DNA, 22 bp, Homo sapiens
tatcgtattaaaggaagtagac

SEQ ID NO: 562938 - DNA, 22 bp, Homo sapiens
gatggaagcccagctgccacct

SEQ ID NO: 562939 - DNA, 22 bp, Homo sapiens
ggcaggagtgcataaacagcta

SEQ ID NO: 562940 - DNA, 22 bp, Homo sapiens
ttgcagacagtgagagtgaaag

SEQ ID NO: 562941 - DNA, 22 bp, Homo sapiens
gggatgggcaaggtagaactca

SEQ ID NO: 562942 - DNA, 22 bp, Homo sapiens
tttctggctgcccatatttttc

SEQ ID NO: 562943 - DNA, 22 bp, Homo sapiens
tccctttactccagttagaact

SEQ ID NO: 562944 - DNA, 22 bp, Homo sapiens
atatctgtggatggatgaattc

SEQ ID NO: 562945 - DNA, 22 bp, Homo sapiens
tcttgtaaataagctgacagta

SEQ ID NO: 562946 - DNA, 22 bp, Homo sapiens
gcactaactccaaaagtgtgga

SEQ ID NO: 562947 - DNA, 22 bp, Homo sapiens
tgacacttttgcctctggtgaa

SEQ ID NO: 562948 - DNA, 22 bp, Homo sapiens
tggggccagagtgctcctttgg

SEQ ID NO: 562949 - DNA, 22 bp, Homo sapiens
gggctcttccttccctgtcata

SEQ ID NO: 562950 - DNA, 22 bp, Homo sapiens
tggaattttcagtccaagaggt

SEQ ID NO: 562951 - DNA, 22 bp, Homo sapiens
aaaatattgtatatcagatgag

SEQ ID NO: 562952 - DNA, 22 bp, Homo sapiens
tcaggatgtagtttcaagggtg

SEQ ID NO: 562953 - DNA, 22 bp, Homo sapiens
cggttcccagactgcactggaa

SEQ ID NO: 562954 - DNA, 22 bp, Homo sapiens
tacatgttccttgctattattc

SEQ ID NO: 562955 - DNA, 22 bp, Homo sapiens
tttccccaacaaatgttgccaa

SEQ ID NO: 562956 - DNA, 22 bp, Homo sapiens
ctgggtgtccagcaccaccccc

SEQ ID NO: 562957 - DNA, 22 bp, Homo sapiens
ctgctctgttctggtctcagag

SEQ ID NO: 562958 - DNA, 22 bp, Homo sapiens
gcagccccttctccctctcagg

SEQ ID NO: 562959 - DNA, 22 bp, Homo sapiens
caaatgtagctggcactacgat

SEQ ID NO: 562960 - DNA, 22 bp, Homo sapiens
tgctggaagaggcaggcaatgt

SEQ ID NO: 562961 - DNA, 22 bp, Homo sapiens
atcatagaggaaaatccacgtt

SEQ ID NO: 562962 - DNA, 22 bp, Homo sapiens
tgctccagctgtgctgcagatg

SEQ ID NO: 562963 - DNA, 22 bp, Homo sapiens
gggtggaggggtgtggggctgt

SEQ ID NO: 562964 - DNA, 22 bp, Homo sapiens
taattcaacgtgcacaaattgt

SEQ ID NO: 562965 - DNA, 22 bp, Homo sapiens
ttaagagaggtaagaagtgggt

SEQ ID NO: 562966 - DNA, 22 bp, Homo sapiens
gggctgtgttgactgcagaagg

SEQ ID NO: 562967 - DNA, 22 bp, Homo sapiens
cagcttcttttcctctctttca

SEQ ID NO: 562968 - DNA, 22 bp, Homo sapiens
cagtggggcctggtcccgagcg

SEQ ID NO: 562969 - DNA, 22 bp, Homo sapiens
taaatttctgtgccagccaaga

SEQ ID NO: 562970 - DNA, 22 bp, Homo sapiens
ttaattaaatctgtatttacat

SEQ ID NO: 562971 - DNA, 22 bp, Homo sapiens
gatacacgaggggcaggagcaa

SEQ ID NO: 562972 - DNA, 22 bp, Homo sapiens
tgattaaaagctatgtgtgata

SEQ ID NO: 562973 - DNA, 22 bp, Homo sapiens
gaggcaggaagggtaaggagaa

SEQ ID NO: 562974 - DNA, 22 bp, Homo sapiens
tagttgaaatgtaatctcttaa

SEQ ID NO: 562975 - DNA, 22 bp, Homo sapiens
gtttgcaggcgtgggggaaggg

SEQ ID NO: 562976 - DNA, 22 bp, Homo sapiens
cacagacctgggtgcccgggcc

SEQ ID NO: 562977 - DNA, 22 bp, Homo sapiens
tgtgaggattaaatgttctaaa

SEQ ID NO: 562978 - DNA, 22 bp, Homo sapiens
caacattgcctatctgttggaa

SEQ ID NO: 562979 - DNA, 22 bp, Homo sapiens
agcattatcctgtaaagtgctg

SEQ ID NO: 562980 - DNA, 22 bp, Homo sapiens
ggaggagccacagcctggtaac

SEQ ID NO: 562981 - DNA, 22 bp, Homo sapiens
cagtgtggcttctgctcaggaa

SEQ ID NO: 562982 - DNA, 22 bp, Homo sapiens
tctcagcagagccaggagagag

SEQ ID NO: 562983 - DNA, 22 bp, Homo sapiens
tcactccagcctggagcccctc

SEQ ID NO: 562984 - DNA, 22 bp, Homo sapiens
tgacatgctggggtggggagaa

SEQ ID NO: 562985 - DNA, 22 bp, Homo sapiens
taattatatgtttgtgtgattg

SEQ ID NO: 562986 - DNA, 22 bp, Homo sapiens
gacctgtctgtcccttatctgt

SEQ ID NO: 562987 - DNA, 22 bp, Homo sapiens
ggaaatgctaagttatttatag

SEQ ID NO: 562988 - DNA, 22 bp, Homo sapiens
tttcgacattaggaaaatgagt

SEQ ID NO: 562989 - DNA, 22 bp, Homo sapiens
gagaggagtaggctgatggtgc

SEQ ID NO: 562990 - DNA, 22 bp, Homo sapiens
tgaatcattagaacatttctga

SEQ ID NO: 562991 - DNA, 22 bp, Homo sapiens
tcttgaatgactgtgattttct

SEQ ID NO: 562992 - DNA, 22 bp, Homo sapiens
tgagttgtatcatacatggata

SEQ ID NO: 562993 - DNA, 22 bp, Homo sapiens
ttcaataccatgcaaaataatt

SEQ ID NO: 562994 - DNA, 22 bp, Homo sapiens
ggagggaatttgggttagatgc

SEQ ID NO: 562995 - DNA, 22 bp, Homo sapiens
tacagggagacggcagtcccag

SEQ ID NO: 562996 - DNA, 22 bp, Homo sapiens
tcgaagcctatctctattaatt

SEQ ID NO: 562997 - DNA, 22 bp, Homo sapiens
cccaaatggccagatctgtgca

SEQ ID NO: 562998 - DNA, 22 bp, Homo sapiens
ctatacttgtgaaatcaaagat

SEQ ID NO: 562999 - DNA, 22 bp, Homo sapiens
atcatacagggacatccagttt

SEQ ID NO: 563000 - DNA, 22 bp, Homo sapiens
tcactacttaatctaattagtt

SEQ ID NO: 563001 - DNA, 20 bp, Homo sapiens
tatgtctgctgaccatcacc

SEQ ID NO: 563002 - DNA, 22 bp, Homo sapiens
acctctgggtgccactgtctgt

SEQ ID NO: 563003 - DNA, 22 bp, Homo sapiens
tgtccataaataaacccggagc

SEQ ID NO: 563004 - DNA, 22 bp, Homo sapiens
tgaatttgaggcgtgggggtgg

SEQ ID NO: 563005 - DNA, 22 bp, Homo sapiens
gctgagagggccctgagagttg

SEQ ID NO: 563006 - DNA, 22 bp, Homo sapiens
gcacatgtgagggatattatct

SEQ ID NO: 563007 - DNA, 22 bp, Homo sapiens
cccctcatggctcctggtccaa

SEQ ID NO: 563008 - DNA, 22 bp, Homo sapiens
taaagcagcgagactgatttga

SEQ ID NO: 563009 - DNA, 22 bp, Homo sapiens
ggggtcctcagtttccccatcc

SEQ ID NO: 563010 - DNA, 22 bp, Homo sapiens
tagacatcgtcagaaaaatcat

SEQ ID NO: 563011 - DNA, 22 bp, Homo sapiens
gccatcaactcttttcagctgg

SEQ ID NO: 563012 - DNA, 22 bp, Homo sapiens
cttcccagcggcagcgctgcac

SEQ ID NO: 563013 - DNA, 22 bp, Homo sapiens
ccaggcttttgtaatctttgct

SEQ ID NO: 563014 - DNA, 22 bp, Homo sapiens
gcagtcattaggcacattagca

SEQ ID NO: 563015 - DNA, 22 bp, Homo sapiens
atcctggaccaggtacttaatc

SEQ ID NO: 563016 - DNA, 22 bp, Homo sapiens
aggatgcctctggatccccacc

SEQ ID NO: 563017 - DNA, 22 bp, Homo sapiens
tgaggaagctagaaatgaagaa

SEQ ID NO: 563018 - DNA, 22 bp, Homo sapiens
tctctgagccttcctgtggcca

SEQ ID NO: 563019 - DNA, 22 bp, Homo sapiens
tcctctctcttcctgacacatt

SEQ ID NO: 563020 - DNA, 22 bp, Homo sapiens
tctgtgtcctatatactatatg

SEQ ID NO: 563021 - DNA, 22 bp, Homo sapiens
tgaagcagtagctccaggagtg

SEQ ID NO: 563022 - DNA, 22 bp, Homo sapiens
tcaccaagggctttgagtgcct

SEQ ID NO: 563023 - DNA, 22 bp, Homo sapiens
caacagttaggagttccctgag

SEQ ID NO: 563024 - DNA, 22 bp, Homo sapiens
tcatgtggtcattgctggccct

SEQ ID NO: 563025 - DNA, 22 bp, Homo sapiens
tggtgctgctgtcatcactgct

SEQ ID NO: 563026 - DNA, 22 bp, Homo sapiens
tcctggttcctgcacgtctcag

SEQ ID NO: 563027 - DNA, 22 bp, Homo sapiens
tcctctgtttgtgacaacataa

SEQ ID NO: 563028 - DNA, 22 bp, Homo sapiens
catgtatgcatgtgcacgtgca

SEQ ID NO: 563029 - DNA, 22 bp, Homo sapiens
cttatctagctcaattcctgag

SEQ ID NO: 563030 - DNA, 22 bp, Homo sapiens
cacagggcacacaggtgcaccc

SEQ ID NO: 563031 - DNA, 22 bp, Homo sapiens
cctctatttaattttctgaact

SEQ ID NO: 563032 - DNA, 22 bp, Homo sapiens
gagtccggggaagcctctcagg

SEQ ID NO: 563033 - DNA, 22 bp, Homo sapiens
tagaagagctttggcaccaggc

SEQ ID NO: 563034 - DNA, 22 bp, Homo sapiens
gcaccctcatttctctatggag

SEQ ID NO: 563035 - DNA, 22 bp, Homo sapiens
taaaatgggtaattgcacacac

SEQ ID NO: 563036 - DNA, 22 bp, Homo sapiens
tgtacatttaagaggttcttga

SEQ ID NO: 563037 - DNA, 22 bp, Homo sapiens
ctgtacagtggctgggggccag

SEQ ID NO: 563038 - DNA, 22 bp, Homo sapiens
ggaggaggagctgaagcttggt

SEQ ID NO: 563039 - DNA, 22 bp, Homo sapiens
tcagaaagtgcatacctccctc

SEQ ID NO: 563040 - DNA, 22 bp, Homo sapiens
tcaattacactcttttcttcct

SEQ ID NO: 563041 - DNA, 22 bp, Homo sapiens
atggcccaagggtggagaggaa

SEQ ID NO: 563042 - DNA, 22 bp, Homo sapiens
tccttgtcttctggtaaatgcc

SEQ ID NO: 563043 - DNA, 22 bp, Homo sapiens
ctctttctgcttcacacatgtc

SEQ ID NO: 563044 - DNA, 22 bp, Homo sapiens
tgttagtcctagaagccacgga

SEQ ID NO: 563045 - DNA, 22 bp, Homo sapiens
ggagtttattagagactgatgg

SEQ ID NO: 563046 - DNA, 22 bp, Homo sapiens
agcggtgggcgcgcacctgcct

SEQ ID NO: 563047 - DNA, 22 bp, Homo sapiens
cactcattgtctgtgcctgaca

SEQ ID NO: 563048 - DNA, 22 bp, Homo sapiens
tcctgctcaccctgtgggtatc

SEQ ID NO: 563049 - DNA, 22 bp, Homo sapiens
aagtttacctgcatggtctggc

SEQ ID NO: 563050 - DNA, 22 bp, Homo sapiens
tacttatgaagtgttaaatgca

SEQ ID NO: 563051 - DNA, 22 bp, Homo sapiens
tttcattttgtgaaagtgaagg

SEQ ID NO: 563052 - DNA, 22 bp, Homo sapiens
ctgggcgccccactcggctcag

SEQ ID NO: 563053 - DNA, 22 bp, Homo sapiens
ggtcccacctgctcctgcaggc

SEQ ID NO: 563054 - DNA, 22 bp, Homo sapiens
tgtgtgtctccactgtgctatt

SEQ ID NO: 563055 - DNA, 22 bp, Homo sapiens
tacgtcctcttccacagctctg

SEQ ID NO: 563056 - DNA, 22 bp, Homo sapiens
aggttttcatgcctgatgatgg

SEQ ID NO: 563057 - DNA, 22 bp, Homo sapiens
cagatgcaattagcctctgggt

SEQ ID NO: 563058 - DNA, 22 bp, Homo sapiens
acttaggacagctggtttacca

SEQ ID NO: 563059 - DNA, 22 bp, Homo sapiens
tgtgttgattccaggggacacc

SEQ ID NO: 563060 - DNA, 22 bp, Homo sapiens
ctgatcttggaatggcacagct

SEQ ID NO: 563061 - DNA, 22 bp, Homo sapiens
ttccccgcgccgccggcccctc

SEQ ID NO: 563062 - DNA, 22 bp, Homo sapiens
aggcagaaaccgcatcaaggaa

SEQ ID NO: 563063 - DNA, 22 bp, Homo sapiens
actgggagggggccagagaccc

SEQ ID NO: 563064 - DNA, 22 bp, Homo sapiens
ctaaacaagatactaatgaggt

SEQ ID NO: 563065 - DNA, 22 bp, Homo sapiens
tagcattgggagatgaattaac

SEQ ID NO: 563066 - DNA, 22 bp, Homo sapiens
cgggaagcgggcagcctccgcc

SEQ ID NO: 563067 - DNA, 22 bp, Homo sapiens
tattgagccctttccatgtgcc

SEQ ID NO: 563068 - DNA, 22 bp, Homo sapiens
tcccattcctagttccttccgc

SEQ ID NO: 563069 - DNA, 22 bp, Homo sapiens
ccctagaccctcaccccaaagg

SEQ ID NO: 563070 - DNA, 22 bp, Homo sapiens
tctgagtggttaagtgagcata

SEQ ID NO: 563071 - DNA, 22 bp, Homo sapiens
tttgctgggcaccaccttgtgt

SEQ ID NO: 563072 - DNA, 22 bp, Homo sapiens
tgcaggtaaaatacttagcaca

SEQ ID NO: 563073 - DNA, 22 bp, Homo sapiens
cgtctgacttctcctgggatca

SEQ ID NO: 563074 - DNA, 22 bp, Homo sapiens
tttctgtcattgattttactga

SEQ ID NO: 563075 - DNA, 22 bp, Homo sapiens
tctccaaggtaaactagctgag

SEQ ID NO: 563076 - DNA, 22 bp, Homo sapiens
tttctgaatgaactgacaattt

SEQ ID NO: 563077 - DNA, 22 bp, Homo sapiens
tttgtagaaccaaacaaaacaa

SEQ ID NO: 563078 - DNA, 22 bp, Homo sapiens
aataatccagaattccttgtgg

SEQ ID NO: 563079 - DNA, 22 bp, Homo sapiens
aatcaggttaccagcagatcat

SEQ ID NO: 563080 - DNA, 22 bp, Homo sapiens
atctccagtactgagtacagtg

SEQ ID NO: 563081 - DNA, 22 bp, Homo sapiens
agggtatagaattaacttgcac

SEQ ID NO: 563082 - DNA, 22 bp, Homo sapiens
agagcccagttcgtgtcagggg

SEQ ID NO: 563083 - DNA, 22 bp, Homo sapiens
tggcttgcttgcatgtaaccta

SEQ ID NO: 563084 - DNA, 22 bp, Homo sapiens
tcctgacccagtcttggccgta

SEQ ID NO: 563085 - DNA, 22 bp, Homo sapiens
aggcttagttttcagagactta

SEQ ID NO: 563086 - DNA, 22 bp, Homo sapiens
tgttagacttgcgtggatcatg

SEQ ID NO: 563087 - DNA, 22 bp, Homo sapiens
accagattcttctcattgtcct

SEQ ID NO: 563088 - DNA, 22 bp, Homo sapiens
aggattagaagatgacccagaa

SEQ ID NO: 563089 - DNA, 22 bp, Homo sapiens
tggtttgaaccattcttggttg

SEQ ID NO: 563090 - DNA, 22 bp, Homo sapiens
acaattgtgggagcactgctgt

SEQ ID NO: 563091 - DNA, 22 bp, Homo sapiens
cccagtgcaagtgtagatgccg

SEQ ID NO: 563092 - DNA, 22 bp, Homo sapiens
tctcacataagaggatccagtg

SEQ ID NO: 563093 - DNA, 22 bp, Homo sapiens
attggatccaactgaccaacct

SEQ ID NO: 563094 - DNA, 22 bp, Homo sapiens
agacatgcagctctagggctcg

SEQ ID NO: 563095 - DNA, 22 bp, Homo sapiens
ttctgttctctcgtttttttcg

SEQ ID NO: 563096 - DNA, 22 bp, Homo sapiens
tcaactttcttcctcccccact

SEQ ID NO: 563097 - DNA, 22 bp, Homo sapiens
tcatgcctctctgtcaatgttg

SEQ ID NO: 563098 - DNA, 22 bp, Homo sapiens
ggcagctttttctgtgtgtttt

SEQ ID NO: 563099 - DNA, 22 bp, Homo sapiens
tcaggaataattatcatatgat

SEQ ID NO: 563100 - DNA, 22 bp, Homo sapiens
ttgccctccctctcagtgcctg

SEQ ID NO: 563101 - DNA, 22 bp, Homo sapiens
gcgtcttggctccgtctgaata

SEQ ID NO: 563102 - DNA, 22 bp, Homo sapiens
ggcctctccccgggaggagaga

SEQ ID NO: 563103 - DNA, 22 bp, Homo sapiens
gagggctatgcggcgggggaga

SEQ ID NO: 563104 - DNA, 22 bp, Homo sapiens
ttctcagagttggagatgaaag

SEQ ID NO: 563105 - DNA, 22 bp, Homo sapiens
actggccattggatttcagtat

SEQ ID NO: 563106 - DNA, 22 bp, Homo sapiens
ttcttgactgcttaggaatgca

SEQ ID NO: 563107 - DNA, 22 bp, Homo sapiens
tatttaagacaggaaccaggag

SEQ ID NO: 563108 - DNA, 22 bp, Homo sapiens
gagaggataccctttgtatgtt

SEQ ID NO: 563109 - DNA, 22 bp, Homo sapiens
ctacaaagggaagcactttctc

SEQ ID NO: 563110 - DNA, 22 bp, Homo sapiens
caggccactccattcatgtata

SEQ ID NO: 563111 - DNA, 22 bp, Homo sapiens
agggggagagggagcaagttgg

SEQ ID NO: 563112 - DNA, 22 bp, Homo sapiens
ctgtcagcccctcctggccttc

SEQ ID NO: 563113 - DNA, 22 bp, Homo sapiens
taatagacttcattatctggct

SEQ ID NO: 563114 - DNA, 22 bp, Homo sapiens
tgctaaattttagcttttctgt

SEQ ID NO: 563115 - DNA, 22 bp, Homo sapiens
gaaattacgaagttaggccaga

SEQ ID NO: 563116 - DNA, 22 bp, Homo sapiens
ctgcagccattgcctggccctg

SEQ ID NO: 563117 - DNA, 22 bp, Homo sapiens
tcaatatttacctcttaggcca

SEQ ID NO: 563118 - DNA, 22 bp, Homo sapiens
atcggtcttggcgctgtatact

SEQ ID NO: 563119 - DNA, 22 bp, Homo sapiens
tgcttattttcgtgtcttagaa

SEQ ID NO: 563120 - DNA, 22 bp, Homo sapiens
tgaactcattactgctctgata

SEQ ID NO: 563121 - DNA, 22 bp, Homo sapiens
ttaaatggcaatgaagtagtaa

SEQ ID NO: 563122 - DNA, 22 bp, Homo sapiens
tctgggcctcagtctccccttc

SEQ ID NO: 563123 - DNA, 22 bp, Homo sapiens
acttcccggtgctcttggcagt

SEQ ID NO: 563124 - DNA, 22 bp, Homo sapiens
ccccgagagttggactccagag

SEQ ID NO: 563125 - DNA, 22 bp, Homo sapiens
aactctgtagtgctatcagggg

SEQ ID NO: 563126 - DNA, 22 bp, Homo sapiens
tagatttgttgcctttcctgga

SEQ ID NO: 563127 - DNA, 22 bp, Homo sapiens
gagtttggccggcagaggaagt

SEQ ID NO: 563128 - DNA, 22 bp, Homo sapiens
gggtctgagggtcccaggcttc

SEQ ID NO: 563129 - DNA, 22 bp, Homo sapiens
ttttattcctttccttgggcta

SEQ ID NO: 563130 - DNA, 22 bp, Homo sapiens
tggggccctgaggccttccccc

SEQ ID NO: 563131 - DNA, 22 bp, Homo sapiens
tgtgctgcaggtcagccctggg

SEQ ID NO: 563132 - DNA, 22 bp, Homo sapiens
tgagctgggggtgggcagaggc

SEQ ID NO: 563133 - DNA, 22 bp, Homo sapiens
catctgcatattgggagacctg

SEQ ID NO: 563134 - DNA, 22 bp, Homo sapiens
tacagccacagtggaaaatggg

SEQ ID NO: 563135 - DNA, 22 bp, Homo sapiens
tgaacattcattccaaggttag

SEQ ID NO: 563136 - DNA, 22 bp, Homo sapiens
gcacaaagcaggcaattctgag

SEQ ID NO: 563137 - DNA, 22 bp, Homo sapiens
ccacattgtttataagtataaa

SEQ ID NO: 563138 - DNA, 22 bp, Homo sapiens
cactggtggaattttttccata

SEQ ID NO: 563139 - DNA, 22 bp, Homo sapiens
ttttaaactggcattgcagtga

SEQ ID NO: 563140 - DNA, 22 bp, Homo sapiens
tgcctgttgatgtgcatgtctg

SEQ ID NO: 563141 - DNA, 22 bp, Homo sapiens
taaagctttcagtgcaatgcct

SEQ ID NO: 563142 - DNA, 22 bp, Homo sapiens
gctttcttttgtttctcttccc

SEQ ID NO: 563143 - DNA, 22 bp, Homo sapiens
tctcttgcactctggagactga

SEQ ID NO: 563144 - DNA, 22 bp, Homo sapiens
gcagttggtgctgaaaaaaaat

SEQ ID NO: 563145 - DNA, 22 bp, Homo sapiens
gctgctacttccagaagtgtcg

SEQ ID NO: 563146 - DNA, 22 bp, Homo sapiens
ttaatactttaaggctctaaag

SEQ ID NO: 563147 - DNA, 22 bp, Homo sapiens
tacgctatacggtctactatct

SEQ ID NO: 563148 - DNA, 22 bp, Homo sapiens
gaggggtctctgcctctaccca

SEQ ID NO: 563149 - DNA, 22 bp, Homo sapiens
ttgctgtggggcagactgtgag

SEQ ID NO: 563150 - DNA, 22 bp, Homo sapiens
tgggagggggcaactgctgagt

SEQ ID NO: 563151 - DNA, 22 bp, Homo sapiens
tccttccaggagcacaccaggg

SEQ ID NO: 563152 - DNA, 22 bp, Homo sapiens
tacacgtccttacaagcagtgc

SEQ ID NO: 563153 - DNA, 22 bp, Homo sapiens
tggggtttggtgaaggttcact

SEQ ID NO: 563154 - DNA, 22 bp, Homo sapiens
tgatgaatggatgtgtaggaag

SEQ ID NO: 563155 - DNA, 22 bp, Homo sapiens
gttgtcccattgcagagcctgg

SEQ ID NO: 563156 - DNA, 22 bp, Homo sapiens
tggggattttctatttcttttt

SEQ ID NO: 563157 - DNA, 22 bp, Homo sapiens
tagaaataatgctgaatggtga

SEQ ID NO: 563158 - DNA, 22 bp, Homo sapiens
attattaaatagctcattgacc

SEQ ID NO: 563159 - DNA, 22 bp, Homo sapiens
tcatgcgcttttcaggagtgtt

SEQ ID NO: 563160 - DNA, 22 bp, Homo sapiens
aatgctaccccagtgtctttga

SEQ ID NO: 563161 - DNA, 22 bp, Homo sapiens
tgagcatgcacgatggggctcg

SEQ ID NO: 563162 - DNA, 22 bp, Homo sapiens
acagaggacctagcatgtgccc

SEQ ID NO: 563163 - DNA, 22 bp, Homo sapiens
tatggtcagactgcctgggtaa

SEQ ID NO: 563164 - DNA, 22 bp, Homo sapiens
cccccacctggaatttgcacac

SEQ ID NO: 563165 - DNA, 22 bp, Homo sapiens
gaagaggcaggaggagctaaaa

SEQ ID NO: 563166 - DNA, 22 bp, Homo sapiens
tggtccctgtgggtcaggtctg

SEQ ID NO: 563167 - DNA, 22 bp, Homo sapiens
ggtgggctcggggctccgagtg

SEQ ID NO: 563168 - DNA, 22 bp, Homo sapiens
aggttggagtttccacagtggt

SEQ ID NO: 563169 - DNA, 22 bp, Homo sapiens
tgattctgttgacatggcatgt

SEQ ID NO: 563170 - DNA, 22 bp, Homo sapiens
caggcctgtctacctggaatag

SEQ ID NO: 563171 - DNA, 22 bp, Homo sapiens
tacctgcagtggcagcttcatt

SEQ ID NO: 563172 - DNA, 22 bp, Homo sapiens
tgcgcagactaattgcctgtgg

SEQ ID NO: 563173 - DNA, 22 bp, Homo sapiens
tcatggatgattagatgtgggg

SEQ ID NO: 563174 - DNA, 22 bp, Homo sapiens
ggcatctatctgtctgactctt

SEQ ID NO: 563175 - DNA, 22 bp, Homo sapiens
caaccatggggataaagcagga

SEQ ID NO: 563176 - DNA, 22 bp, Homo sapiens
caaaactcagtgcagaagagcc

SEQ ID NO: 563177 - DNA, 22 bp, Homo sapiens
catcatttgtagttacaggtag

SEQ ID NO: 563178 - DNA, 22 bp, Homo sapiens
cagatgctcaataaacatttgc

SEQ ID NO: 563179 - DNA, 22 bp, Homo sapiens
ttggtatgcagaacacacagtc

SEQ ID NO: 563180 - DNA, 22 bp, Homo sapiens
ggatggacctgtccctttctag

SEQ ID NO: 563181 - DNA, 22 bp, Homo sapiens
cagcaaaaaattaacatctctt

SEQ ID NO: 563182 - DNA, 22 bp, Homo sapiens
gcagagccaaaaccgtaacagc

SEQ ID NO: 563183 - DNA, 22 bp, Homo sapiens
tgatgggctcggttgcaaggct

SEQ ID NO: 563184 - DNA, 22 bp, Homo sapiens
tgagcggaattggagagggaag

SEQ ID NO: 563185 - DNA, 22 bp, Homo sapiens
ccagggccagatggaggatagg

SEQ ID NO: 563186 - DNA, 22 bp, Homo sapiens
atggtgagaagtgaccccagag

SEQ ID NO: 563187 - DNA, 22 bp, Homo sapiens
taagttgtatgacgaactgtga

SEQ ID NO: 563188 - DNA, 22 bp, Homo sapiens
tttgaaaatgtggcagtgggtg

SEQ ID NO: 563189 - DNA, 22 bp, Homo sapiens
aaaggcaagacagaaaaattta

SEQ ID NO: 563190 - DNA, 22 bp, Homo sapiens
tgcctacatgttacagtggtga

SEQ ID NO: 563191 - DNA, 22 bp, Homo sapiens
cctttctcctggcccagctttc

SEQ ID NO: 563192 - DNA, 22 bp, Homo sapiens
gcaactggcacctgcaaatccc

SEQ ID NO: 563193 - DNA, 22 bp, Homo sapiens
ccacccccatgccgcgtgctcc

SEQ ID NO: 563194 - DNA, 22 bp, Homo sapiens
taggggttacctttagcatctc

SEQ ID NO: 563195 - DNA, 22 bp, Homo sapiens
ggcaggagagcagaaaggagaa

SEQ ID NO: 563196 - DNA, 22 bp, Homo sapiens
aagagaaatatttccatggaag

SEQ ID NO: 563197 - DNA, 22 bp, Homo sapiens
gtttagccatttaggaattgga

SEQ ID NO: 563198 - DNA, 22 bp, Homo sapiens
agagctagtaggtagtagagtt

SEQ ID NO: 563199 - DNA, 22 bp, Homo sapiens
cggcaggcgggaaaagcgcgca

SEQ ID NO: 563200 - DNA, 22 bp, Homo sapiens
ttgttaaagaggaaaagtggta

SEQ ID NO: 563201 - DNA, 22 bp, Homo sapiens
cagcctcgtaggaggggctggt

SEQ ID NO: 563202 - DNA, 22 bp, Homo sapiens
ccttcttcatccttcttgctgg

SEQ ID NO: 563203 - DNA, 22 bp, Homo sapiens
tcatccatttgttcagtgtttt

SEQ ID NO: 563204 - DNA, 22 bp, Homo sapiens
tcctcaaggcagagaagggact

SEQ ID NO: 563205 - DNA, 22 bp, Homo sapiens
tcttgatgcttgtttaaaggtt

SEQ ID NO: 563206 - DNA, 22 bp, Homo sapiens
ggatttagatctaaggacttaa

SEQ ID NO: 563207 - DNA, 22 bp, Homo sapiens
ccttgcctgggttcaaatcctg

SEQ ID NO: 563208 - DNA, 22 bp, Homo sapiens
tgtggcctgggccgatttcttt

SEQ ID NO: 563209 - DNA, 22 bp, Homo sapiens
ccctgtggcagagccctgatca

SEQ ID NO: 563210 - DNA, 22 bp, Homo sapiens
cgaacaaactctgcaatgcttt

SEQ ID NO: 563211 - DNA, 22 bp, Homo sapiens
tcacactgggcccactttgctc

SEQ ID NO: 563212 - DNA, 22 bp, Homo sapiens
tgtgtgtgtgtccgtcccccca

SEQ ID NO: 563213 - DNA, 22 bp, Homo sapiens
tggagggagagaaggcaaggat

SEQ ID NO: 563214 - DNA, 22 bp, Homo sapiens
tcacacgcctcccgttccccca

SEQ ID NO: 563215 - DNA, 22 bp, Homo sapiens
ctcggggcttatgggcagtttt

SEQ ID NO: 563216 - DNA, 22 bp, Homo sapiens
gccccgcccccgcccccactgc

SEQ ID NO: 563217 - DNA, 22 bp, Homo sapiens
tacatggaagcagatctgagaa

SEQ ID NO: 563218 - DNA, 22 bp, Homo sapiens
tgcccaagaagccaaagtctgt

SEQ ID NO: 563219 - DNA, 22 bp, Homo sapiens
ccccccttccccagggccctag

SEQ ID NO: 563220 - DNA, 22 bp, Homo sapiens
ccccgctggttgatcacctgta

SEQ ID NO: 563221 - DNA, 22 bp, Homo sapiens
gacagacgcaggtacacacaga

SEQ ID NO: 563222 - DNA, 22 bp, Homo sapiens
tatcaatgacctgaagacatgg

SEQ ID NO: 563223 - DNA, 22 bp, Homo sapiens
cagctgtaggcagctgttagta

SEQ ID NO: 563224 - DNA, 22 bp, Homo sapiens
ttgctttttctctttggggaca

SEQ ID NO: 563225 - DNA, 22 bp, Homo sapiens
aggcttggggtaatgtatggca

SEQ ID NO: 563226 - DNA, 22 bp, Homo sapiens
tgtgactcatctattagagtgg

SEQ ID NO: 563227 - DNA, 22 bp, Homo sapiens
ttacacatgggaacctgatcag

SEQ ID NO: 563228 - DNA, 22 bp, Homo sapiens
tgctggctgagggacacaggct

SEQ ID NO: 563229 - DNA, 22 bp, Homo sapiens
tcacccttgataatgttcttct

SEQ ID NO: 563230 - DNA, 22 bp, Homo sapiens
tggtttctgactaccgcttagg

SEQ ID NO: 563231 - DNA, 22 bp, Homo sapiens
agtagccagcaataagtagtgc

SEQ ID NO: 563232 - DNA, 22 bp, Homo sapiens
acccccggccctcgcgcctgcc

SEQ ID NO: 563233 - DNA, 22 bp, Homo sapiens
taaagctgatgtgttgaccctg

SEQ ID NO: 563234 - DNA, 22 bp, Homo sapiens
tattttgcctaagaatctctct

SEQ ID NO: 563235 - DNA, 22 bp, Homo sapiens
tcttgccgggtctcagcgcagt

SEQ ID NO: 563236 - DNA, 22 bp, Homo sapiens
tccttactttgttctgggcatt

SEQ ID NO: 563237 - DNA, 22 bp, Homo sapiens
gctcaatgataccccagtgttc

SEQ ID NO: 563238 - DNA, 22 bp, Homo sapiens
agagagactgggtggttgaggg

SEQ ID NO: 563239 - DNA, 22 bp, Homo sapiens
cacacaactgagcatcacagcc

SEQ ID NO: 563240 - DNA, 22 bp, Homo sapiens
ggaagctggagtaaattctgta

SEQ ID NO: 563241 - DNA, 22 bp, Homo sapiens
tgaggatgggcagctccgtccc

SEQ ID NO: 563242 - DNA, 22 bp, Homo sapiens
tgacccagctcttttcctgttc

SEQ ID NO: 563243 - DNA, 22 bp, Homo sapiens
tcaggatgtggtcaagtgttgt

SEQ ID NO: 563244 - DNA, 22 bp, Homo sapiens
aaggggacagtgagtgtgcttg

SEQ ID NO: 563245 - DNA, 22 bp, Homo sapiens
ttaagacttgcagtgatgttta

SEQ ID NO: 563246 - DNA, 22 bp, Homo sapiens
caaagctgaagggcaggatgtg

SEQ ID NO: 563247 - DNA, 22 bp, Homo sapiens
ttaaatctcttatttgctgtaa

SEQ ID NO: 563248 - DNA, 22 bp, Homo sapiens
tcctgggcagttttgagtgcta

SEQ ID NO: 563249 - DNA, 22 bp, Homo sapiens
ccttctttgaaactcgctgatt

SEQ ID NO: 563250 - DNA, 22 bp, Homo sapiens
tggggggtggcagcaggtggag

SEQ ID NO: 563251 - DNA, 22 bp, Homo sapiens
ttaaattgctacagtaattcaa

SEQ ID NO: 563252 - DNA, 22 bp, Homo sapiens
cagcctacttggactgagcctg

SEQ ID NO: 563253 - DNA, 22 bp, Homo sapiens
tcttttggggaagtttgggatc

SEQ ID NO: 563254 - DNA, 22 bp, Homo sapiens
taactatagatgctgggagaag

SEQ ID NO: 563255 - DNA, 22 bp, Homo sapiens
cccgacatctcctgcccacttc

SEQ ID NO: 563256 - DNA, 22 bp, Homo sapiens
agattcctgctttctccactca

SEQ ID NO: 563257 - DNA, 22 bp, Homo sapiens
tttaggggatcgagggctggcg

SEQ ID NO: 563258 - DNA, 22 bp, Homo sapiens
ttagtagggtgttcaaatgtgc

SEQ ID NO: 563259 - DNA, 22 bp, Homo sapiens
tatccctgccctccagaagctc

SEQ ID NO: 563260 - DNA, 22 bp, Homo sapiens
ccagaacagagcttctatttca

SEQ ID NO: 563261 - DNA, 22 bp, Homo sapiens
gaaattggcaagaagagcagag

SEQ ID NO: 563262 - DNA, 22 bp, Homo sapiens
taatcccaaatctgtcaggcct

SEQ ID NO: 563263 - DNA, 22 bp, Homo sapiens
aaggcagggtgggaggggagta

SEQ ID NO: 563264 - DNA, 22 bp, Homo sapiens
tcagttatgggagtgtggctgg

SEQ ID NO: 563265 - DNA, 22 bp, Homo sapiens
tgaccagctgggggagttgata

SEQ ID NO: 563266 - DNA, 22 bp, Homo sapiens
ctgggaggagggtggagccagc

SEQ ID NO: 563267 - DNA, 22 bp, Homo sapiens
tgttggctagatgagaaaggct

SEQ ID NO: 563268 - DNA, 22 bp, Homo sapiens
tatgactccctgtggtatttta

SEQ ID NO: 563269 - DNA, 22 bp, Homo sapiens
agtttatgaccaactgaggcca

SEQ ID NO: 563270 - DNA, 22 bp, Homo sapiens
ggtttgagtgcagggtgtagga

SEQ ID NO: 563271 - DNA, 22 bp, Homo sapiens
aacccttcaccgagtgtggtgg

SEQ ID NO: 563272 - DNA, 22 bp, Homo sapiens
taaactgtgggcatttatttac

SEQ ID NO: 563273 - DNA, 22 bp, Homo sapiens
gcagctcctcctgtcatctgtc

SEQ ID NO: 563274 - DNA, 22 bp, Homo sapiens
gagtttgggtcacacgtgagct

SEQ ID NO: 563275 - DNA, 22 bp, Homo sapiens
cagttcactcctggccgagttg

SEQ ID NO: 563276 - DNA, 22 bp, Homo sapiens
tgatttctaatccctagtggag

SEQ ID NO: 563277 - DNA, 22 bp, Homo sapiens
tgcagccggttgccgggtgacg

SEQ ID NO: 563278 - DNA, 22 bp, Homo sapiens
caggtggaagcatggactttgc

SEQ ID NO: 563279 - DNA, 22 bp, Homo sapiens
tgcaacagaaaattgcctgggt

SEQ ID NO: 563280 - DNA, 22 bp, Homo sapiens
tgctgagattcacctgaatgtg

SEQ ID NO: 563281 - DNA, 22 bp, Homo sapiens
tgaagtcccaaactggagtgga

SEQ ID NO: 563282 - DNA, 22 bp, Homo sapiens
tgtccgatacaggcagtggtct

SEQ ID NO: 563283 - DNA, 22 bp, Homo sapiens
agagagggatttaatgttaatt

SEQ ID NO: 563284 - DNA, 22 bp, Homo sapiens
gcagatcgtttaacttctctct

SEQ ID NO: 563285 - DNA, 22 bp, Homo sapiens
tgctagcctcagatttatccct

SEQ ID NO: 563286 - DNA, 22 bp, Homo sapiens
aagagaagcaaggctctgaatt

SEQ ID NO: 563287 - DNA, 22 bp, Homo sapiens
ttgtgggtctagtgcattttgt

SEQ ID NO: 563288 - DNA, 22 bp, Homo sapiens
gggcagggaggaaggccctgtg

SEQ ID NO: 563289 - DNA, 22 bp, Homo sapiens
taattagtggggaagaatatcg

SEQ ID NO: 563290 - DNA, 22 bp, Homo sapiens
ttcaatttatttcctaggatat

SEQ ID NO: 563291 - DNA, 22 bp, Homo sapiens
tggtgcctcctctagcttgtag

SEQ ID NO: 563292 - DNA, 22 bp, Homo sapiens
cccacacctccgtatatcacta

SEQ ID NO: 563293 - DNA, 22 bp, Homo sapiens
gaaagcaagccattcactgtca

SEQ ID NO: 563294 - DNA, 22 bp, Homo sapiens
tgttgctttcttaatggcaaat

SEQ ID NO: 563295 - DNA, 22 bp, Homo sapiens
tcctgtggctttttgagttttg

SEQ ID NO: 563296 - DNA, 22 bp, Homo sapiens
agggttcatccacatgctctct

SEQ ID NO: 563297 - DNA, 22 bp, Homo sapiens
ttcatgcgatggttggagggat

SEQ ID NO: 563298 - DNA, 22 bp, Homo sapiens
tagatcaatttatctcttgtcc

SEQ ID NO: 563299 - DNA, 22 bp, Homo sapiens
tgccccctcccccttccgctgt

SEQ ID NO: 563300 - DNA, 22 bp, Homo sapiens
tccttgggaatgatttcaggtg

SEQ ID NO: 563301 - DNA, 22 bp, Homo sapiens
gattctcaggggacaggctgac

SEQ ID NO: 563302 - DNA, 22 bp, Homo sapiens
gagggaggcagggcagaagtgg

SEQ ID NO: 563303 - DNA, 22 bp, Homo sapiens
tgagtgcacagatagcaataag

SEQ ID NO: 563304 - DNA, 22 bp, Homo sapiens
tgatttttctgataatttggaa

SEQ ID NO: 563305 - DNA, 22 bp, Homo sapiens
tttgtccattattatccttgag

SEQ ID NO: 563306 - DNA, 22 bp, Homo sapiens
gctacttttcacctagggtttc

SEQ ID NO: 563307 - DNA, 22 bp, Homo sapiens
tcttggccgccatcttcgcctt

SEQ ID NO: 563308 - DNA, 22 bp, Homo sapiens
tagttattccacacccattatc

SEQ ID NO: 563309 - DNA, 22 bp, Homo sapiens
tgaaggaggtcatttataccaa

SEQ ID NO: 563310 - DNA, 22 bp, Homo sapiens
aggcccattggatcctggccat

SEQ ID NO: 563311 - DNA, 22 bp, Homo sapiens
gctgaggcctgcagtagactgt

SEQ ID NO: 563312 - DNA, 22 bp, Homo sapiens
tggttgtccattctatttcagt

SEQ ID NO: 563313 - DNA, 22 bp, Homo sapiens
tatcacctttcctggccctgtc

SEQ ID NO: 563314 - DNA, 22 bp, Homo sapiens
tctccccccaccctccctgccc

SEQ ID NO: 563315 - DNA, 22 bp, Homo sapiens
ggtcagttttctccaggatcca

SEQ ID NO: 563316 - DNA, 22 bp, Homo sapiens
tgggtccccagttcctgagcag

SEQ ID NO: 563317 - DNA, 22 bp, Homo sapiens
accatagtccagcgtgctgccc

SEQ ID NO: 563318 - DNA, 22 bp, Homo sapiens
atgcaggccacccccagccttc

SEQ ID NO: 563319 - DNA, 22 bp, Homo sapiens
tctgtgtcctgggctctgagcg

SEQ ID NO: 563320 - DNA, 22 bp, Homo sapiens
tgagttgacctccacagggcca

SEQ ID NO: 563321 - DNA, 22 bp, Homo sapiens
agactagattggcaggttgggg

SEQ ID NO: 563322 - DNA, 22 bp, Homo sapiens
aatggttggggacatttggcaa

SEQ ID NO: 563323 - DNA, 22 bp, Homo sapiens
tggctgcaaagggaactggtga

SEQ ID NO: 563324 - DNA, 22 bp, Homo sapiens
caagggtcagggccgaagggag

SEQ ID NO: 563325 - DNA, 22 bp, Homo sapiens
aaaaccaggattttgttttgcc

SEQ ID NO: 563326 - DNA, 22 bp, Homo sapiens
ttaccggtactcactccatgct

SEQ ID NO: 563327 - DNA, 22 bp, Homo sapiens
tctgaagttgcaggagaagctt

SEQ ID NO: 563328 - DNA, 22 bp, Homo sapiens
aaatagaggggattgtcagttc

SEQ ID NO: 563329 - DNA, 22 bp, Homo sapiens
gctgcaactagagcttaaactt

SEQ ID NO: 563330 - DNA, 22 bp, Homo sapiens
tgtcctctgccatggttgggat

SEQ ID NO: 563331 - DNA, 22 bp, Homo sapiens
atggcaatgccctggctctcct

SEQ ID NO: 563332 - DNA, 22 bp, Homo sapiens
tatgcatgaggagaggactgag

SEQ ID NO: 563333 - DNA, 22 bp, Homo sapiens
taaatgagagctcctttttctc

SEQ ID NO: 563334 - DNA, 22 bp, Homo sapiens
tccagattgatccagcccttgg

SEQ ID NO: 563335 - DNA, 22 bp, Homo sapiens
ttgaatcccacctctactccta

SEQ ID NO: 563336 - DNA, 22 bp, Homo sapiens
tgctcaggccttgtggctgctg

SEQ ID NO: 563337 - DNA, 22 bp, Homo sapiens
tgtttgccgcgacgtactgagt

SEQ ID NO: 563338 - DNA, 22 bp, Homo sapiens
taaactaatgtgtcagccaaga

SEQ ID NO: 563339 - DNA, 22 bp, Homo sapiens
gggagggatagacatgatttgg

SEQ ID NO: 563340 - DNA, 22 bp, Homo sapiens
cacccccactccccagctggtg

SEQ ID NO: 563341 - DNA, 22 bp, Homo sapiens
agtgttgtatagaaatcaatga

SEQ ID NO: 563342 - DNA, 22 bp, Homo sapiens
tgattctctagctgtgataaac

SEQ ID NO: 563343 - DNA, 22 bp, Homo sapiens
tagggataaggttctgatgtgc

SEQ ID NO: 563344 - DNA, 22 bp, Homo sapiens
ttctaaggaataagaagggggt

SEQ ID NO: 563345 - DNA, 22 bp, Homo sapiens
gcgcccccggcctgccccagag

SEQ ID NO: 563346 - DNA, 22 bp, Homo sapiens
ctaagtctgtgcccagaagaga

SEQ ID NO: 563347 - DNA, 22 bp, Homo sapiens
tgggtaccacctcactgaattc

SEQ ID NO: 563348 - DNA, 22 bp, Homo sapiens
tccatagacctctattttctct

SEQ ID NO: 563349 - DNA, 22 bp, Homo sapiens
agaggatgtgacctgtggccca

SEQ ID NO: 563350 - DNA, 22 bp, Homo sapiens
agctttggcccggtgttaatta

SEQ ID NO: 563351 - DNA, 22 bp, Homo sapiens
tccaggtgagcacaggaggggc

SEQ ID NO: 563352 - DNA, 22 bp, Homo sapiens
aacatggcttgcgcgttgtggt

SEQ ID NO: 563353 - DNA, 22 bp, Homo sapiens
cactctgtgagtgtggtgaata

SEQ ID NO: 563354 - DNA, 22 bp, Homo sapiens
taaacattcttcctctgaggca

SEQ ID NO: 563355 - DNA, 22 bp, Homo sapiens
agtgcagctctgagttaaaaca

SEQ ID NO: 563356 - DNA, 22 bp, Homo sapiens
tcttttgtaatgaccctaacag

SEQ ID NO: 563357 - DNA, 22 bp, Homo sapiens
tgacgtgtgggacccaggcatt

SEQ ID NO: 563358 - DNA, 22 bp, Homo sapiens
tgaccgctgggaatgcagccaa

SEQ ID NO: 563359 - DNA, 22 bp, Homo sapiens
tgaggcaggaggatggaggaga

SEQ ID NO: 563360 - DNA, 22 bp, Homo sapiens
tgtcagcaccctgcccacatgc

SEQ ID NO: 563361 - DNA, 22 bp, Homo sapiens
cctaaatattctggtttggctg

SEQ ID NO: 563362 - DNA, 22 bp, Homo sapiens
aatgaaaagcagaaggagttgg

SEQ ID NO: 563363 - DNA, 22 bp, Homo sapiens
agacataaggaatggcttttac

SEQ ID NO: 563364 - DNA, 22 bp, Homo sapiens
tgtgcctacatttcaatttcca

SEQ ID NO: 563365 - DNA, 22 bp, Homo sapiens
tggagcagaggaggaagggcac

SEQ ID NO: 563366 - DNA, 22 bp, Homo sapiens
gcccgaccgcgccggcccgcac

SEQ ID NO: 563367 - DNA, 22 bp, Homo sapiens
ggctccaaaccacatgctggac

SEQ ID NO: 563368 - DNA, 22 bp, Homo sapiens
ctccagcccaggggcaggtgac

SEQ ID NO: 563369 - DNA, 22 bp, Homo sapiens
gctcatctgcaccttggttctc

SEQ ID NO: 563370 - DNA, 22 bp, Homo sapiens
aatggaaggttggtggtggagg

SEQ ID NO: 563371 - DNA, 22 bp, Homo sapiens
ccacggaaagagcatttttgtg

SEQ ID NO: 563372 - DNA, 22 bp, Homo sapiens
gcatgactttgttgatttctga

SEQ ID NO: 563373 - DNA, 22 bp, Homo sapiens
gctgcctcagtgattgggaagg

SEQ ID NO: 563374 - DNA, 22 bp, Homo sapiens
atgcatgcatccacaagttaaa

SEQ ID NO: 563375 - DNA, 22 bp, Homo sapiens
agctcgtcagctactgtaggtg

SEQ ID NO: 563376 - DNA, 22 bp, Homo sapiens
ttcctaaatcacctccctccag

SEQ ID NO: 563377 - DNA, 22 bp, Homo sapiens
taattgggagagaagggaatta

SEQ ID NO: 563378 - DNA, 22 bp, Homo sapiens
taagttttgactagctcataat

SEQ ID NO: 563379 - DNA, 22 bp, Homo sapiens
tcatggagtctcctaatatgag

SEQ ID NO: 563380 - DNA, 22 bp, Homo sapiens
gcattgtaggcaggtgttcttt

SEQ ID NO: 563381 - DNA, 22 bp, Homo sapiens
ctgtggaaaggagagaggagac

SEQ ID NO: 563382 - DNA, 22 bp, Homo sapiens
ctgctctggttcttttctgagg

SEQ ID NO: 563383 - DNA, 22 bp, Homo sapiens
gggttgagcttatggctggttc

SEQ ID NO: 563384 - DNA, 22 bp, Homo sapiens
tcctctcttgctctcagtccat

SEQ ID NO: 563385 - DNA, 22 bp, Homo sapiens
ggagttctacatttgttgatga

SEQ ID NO: 563386 - DNA, 22 bp, Homo sapiens
cagagcagtggggtgtgttggg

SEQ ID NO: 563387 - DNA, 22 bp, Homo sapiens
tcctttctagttaccattttgc

SEQ ID NO: 563388 - DNA, 22 bp, Homo sapiens
gcttcctgctccatcctgacct

SEQ ID NO: 563389 - DNA, 22 bp, Homo sapiens
tcccccatggctgacagaccac

SEQ ID NO: 563390 - DNA, 22 bp, Homo sapiens
acacctttctcttgtacagttt

SEQ ID NO: 563391 - DNA, 22 bp, Homo sapiens
gtcgcctgtcggaaatggctgc

SEQ ID NO: 563392 - DNA, 22 bp, Homo sapiens
ggggatgggagggtggcgcgtg

SEQ ID NO: 563393 - DNA, 22 bp, Homo sapiens
tgcaatatatttttacaatgtg

SEQ ID NO: 563394 - DNA, 22 bp, Homo sapiens
aggagaacaaggccatggtctg

SEQ ID NO: 563395 - DNA, 22 bp, Homo sapiens
tgaagaaggaattggggcacag

SEQ ID NO: 563396 - DNA, 22 bp, Homo sapiens
gaggagctgggcagctgtcatg

SEQ ID NO: 563397 - DNA, 22 bp, Homo sapiens
tcccactgccctgagcttggag

SEQ ID NO: 563398 - DNA, 22 bp, Homo sapiens
tccccacggctggcgggctcag

SEQ ID NO: 563399 - DNA, 22 bp, Homo sapiens
ggagggcagggccctaagatac

SEQ ID NO: 563400 - DNA, 22 bp, Homo sapiens
ttggccctctagagaaggcaga

SEQ ID NO: 563401 - DNA, 22 bp, Homo sapiens
gggacgcctggctctcattgtc

SEQ ID NO: 563402 - DNA, 22 bp, Homo sapiens
tgcagcccagtggcgaggtggg

SEQ ID NO: 563403 - DNA, 22 bp, Homo sapiens
taatgaagaagtttgctgtgtg

SEQ ID NO: 563404 - DNA, 22 bp, Homo sapiens
aagcccagcctcaagcttgctg

SEQ ID NO: 563405 - DNA, 22 bp, Homo sapiens
tcatgcagcgagcgggcggcgc

SEQ ID NO: 563406 - DNA, 22 bp, Homo sapiens
ggcatcctccactgaccaggca

SEQ ID NO: 563407 - DNA, 22 bp, Homo sapiens
ctacttgagctaaacttctgca

SEQ ID NO: 563408 - DNA, 22 bp, Homo sapiens
tgctggcagcttcctccttctc

SEQ ID NO: 563409 - DNA, 22 bp, Homo sapiens
tgggaagggtgggagtggtggg

SEQ ID NO: 563410 - DNA, 22 bp, Homo sapiens
tgcttgagtatggaactatggc

SEQ ID NO: 563411 - DNA, 22 bp, Homo sapiens
tattagagatggttactgttaa

SEQ ID NO: 563412 - DNA, 22 bp, Homo sapiens
acatctgcatttttagcagagt

SEQ ID NO: 563413 - DNA, 22 bp, Homo sapiens
taaaaggtttctaaatgatgtt

SEQ ID NO: 563414 - DNA, 22 bp, Homo sapiens
tggcctggaagctaggataggg

SEQ ID NO: 563415 - DNA, 22 bp, Homo sapiens
ggctgtgtcactgtgggtatag

SEQ ID NO: 563416 - DNA, 22 bp, Homo sapiens
tggcttgtgaacattgctcagc

SEQ ID NO: 563417 - DNA, 22 bp, Homo sapiens
ccgagttggggtgggggtggcg

SEQ ID NO: 563418 - DNA, 22 bp, Homo sapiens
gagctgatcgagagagccgtct

SEQ ID NO: 563419 - DNA, 22 bp, Homo sapiens
ttttatttacctgagagaacca

SEQ ID NO: 563420 - DNA, 22 bp, Homo sapiens
agggaaagaataaccagagtca

SEQ ID NO: 563421 - DNA, 22 bp, Homo sapiens
ttcaggcagcgatggagacttt

SEQ ID NO: 563422 - DNA, 22 bp, Homo sapiens
cggggccccccagtgaacctct

SEQ ID NO: 563423 - DNA, 22 bp, Homo sapiens
gactattgaaggccacttcctg

SEQ ID NO: 563424 - DNA, 22 bp, Homo sapiens
tggggagaggaattgggaaggt

SEQ ID NO: 563425 - DNA, 22 bp, Homo sapiens
gctctgggggtcaggcagctgg

SEQ ID NO: 563426 - DNA, 22 bp, Homo sapiens
tgatctttcccttcagcgttag

SEQ ID NO: 563427 - DNA, 22 bp, Homo sapiens
tcgtcattatgcagcctgtgaa

SEQ ID NO: 563428 - DNA, 22 bp, Homo sapiens
tcagataagatagcgtctgccc

SEQ ID NO: 563429 - DNA, 22 bp, Homo sapiens
gggaaaggaagtctgtgaggaa

SEQ ID NO: 563430 - DNA, 22 bp, Homo sapiens
aagtggctgagacaccaatttc

SEQ ID NO: 563431 - DNA, 22 bp, Homo sapiens
tggaaaccatagctgtctcctg

SEQ ID NO: 563432 - DNA, 22 bp, Homo sapiens
tggtctattactcacaccttat

SEQ ID NO: 563433 - DNA, 22 bp, Homo sapiens
acagagttccccagcatcaatc

SEQ ID NO: 563434 - DNA, 22 bp, Homo sapiens
aaattagagcagttggggtcat

SEQ ID NO: 563435 - DNA, 22 bp, Homo sapiens
tgtctatcagccactcccagtt

SEQ ID NO: 563436 - DNA, 22 bp, Homo sapiens
tgggtctagttggagcccccag

SEQ ID NO: 563437 - DNA, 22 bp, Homo sapiens
aggaatcagaggaatgtgtcaa

SEQ ID NO: 563438 - DNA, 22 bp, Homo sapiens
tcccatgcctctggggtcatct

SEQ ID NO: 563439 - DNA, 22 bp, Homo sapiens
cgtagacagactctttgggaga

SEQ ID NO: 563440 - DNA, 22 bp, Homo sapiens
tggcaaggagttggggaaaaaa

SEQ ID NO: 563441 - DNA, 22 bp, Homo sapiens
ccagcaataaagattttactgt

SEQ ID NO: 563442 - DNA, 22 bp, Homo sapiens
ttgtgcaagtgcctcccacaca

SEQ ID NO: 563443 - DNA, 22 bp, Homo sapiens
gttggtgactttgggcaagaga

SEQ ID NO: 563444 - DNA, 22 bp, Homo sapiens
aagtgagtctgtgggttcccct

SEQ ID NO: 563445 - DNA, 22 bp, Homo sapiens
tgccccaggtctttattcttgc

SEQ ID NO: 563446 - DNA, 22 bp, Homo sapiens
tcaggaaccttgggagtaactg

SEQ ID NO: 563447 - DNA, 22 bp, Homo sapiens
tacacaaaaatcccctggtcac

SEQ ID NO: 563448 - DNA, 22 bp, Homo sapiens
tctgaccctaggaggtctacag

SEQ ID NO: 563449 - DNA, 22 bp, Homo sapiens
catcctagcaccgtctgacatc

SEQ ID NO: 563450 - DNA, 22 bp, Homo sapiens
tgaatcctggctttaccactta

SEQ ID NO: 563451 - DNA, 22 bp, Homo sapiens
cactaggtacctagtaatttaa

SEQ ID NO: 563452 - DNA, 22 bp, Homo sapiens
tacctttgtgccacacagctcg

SEQ ID NO: 563453 - DNA, 22 bp, Homo sapiens
gaaagcaactgatgaactgtct

SEQ ID NO: 563454 - DNA, 22 bp, Homo sapiens
actcagttggtcataaactcca

SEQ ID NO: 563455 - DNA, 22 bp, Homo sapiens
agccagcttgtaagtcctggat

SEQ ID NO: 563456 - DNA, 22 bp, Homo sapiens
cagctggccattaatcccctag

SEQ ID NO: 563457 - DNA, 22 bp, Homo sapiens
tgcaggagggagggagcagtga

SEQ ID NO: 563458 - DNA, 22 bp, Homo sapiens
tcttgcattttgattttggtct

SEQ ID NO: 563459 - DNA, 22 bp, Homo sapiens
tacgtacttagtgctctatctg

SEQ ID NO: 563460 - DNA, 22 bp, Homo sapiens
tggtggtgccaggcttctgatt

SEQ ID NO: 563461 - DNA, 22 bp, Homo sapiens
tgcagctgtttacagatgcatt

SEQ ID NO: 563462 - DNA, 22 bp, Homo sapiens
tgggctgtgtgtctctgttttg

SEQ ID NO: 563463 - DNA, 22 bp, Homo sapiens
caagactctagcagggcagttg

SEQ ID NO: 563464 - DNA, 22 bp, Homo sapiens
ttttgtgcctatttgaacctac

SEQ ID NO: 563465 - DNA, 22 bp, Homo sapiens
tgagcgtgggttggggactggg

SEQ ID NO: 563466 - DNA, 22 bp, Homo sapiens
ttaatatgcaaattctaagtgg

SEQ ID NO: 563467 - DNA, 22 bp, Homo sapiens
tggcctgtgccccagcaggtga

SEQ ID NO: 563468 - DNA, 22 bp, Homo sapiens
tcttgtggggtgaggtgcctct

SEQ ID NO: 563469 - DNA, 22 bp, Homo sapiens
tttgcttagcagtgctgggaag

SEQ ID NO: 563470 - DNA, 22 bp, Homo sapiens
ggcggacgcccgggggccggga

SEQ ID NO: 563471 - DNA, 22 bp, Homo sapiens
tctgccccctggtctagctatc

SEQ ID NO: 563472 - DNA, 22 bp, Homo sapiens
taacgttggattacttgcttta

SEQ ID NO: 563473 - DNA, 22 bp, Homo sapiens
gagcccgcacgctgctcccggg

SEQ ID NO: 563474 - DNA, 22 bp, Homo sapiens
taatcccagtccttaggtagtg

SEQ ID NO: 563475 - DNA, 22 bp, Homo sapiens
gaggagagagagcgaggctttg

SEQ ID NO: 563476 - DNA, 22 bp, Homo sapiens
cctcttgccaccctctactctc

SEQ ID NO: 563477 - DNA, 22 bp, Homo sapiens
cgttttgggggcatcatcagac

SEQ ID NO: 563478 - DNA, 22 bp, Homo sapiens
tattgattcctgcagctgttta

SEQ ID NO: 563479 - DNA, 22 bp, Homo sapiens
actataaaatgtagagagcgat

SEQ ID NO: 563480 - DNA, 22 bp, Homo sapiens
taatactcctagtggggggggt

SEQ ID NO: 563481 - DNA, 22 bp, Homo sapiens
ttcttttaggaaaagatttgta

SEQ ID NO: 563482 - DNA, 22 bp, Homo sapiens
tgaattctttggcttttctttt

SEQ ID NO: 563483 - DNA, 22 bp, Homo sapiens
tcattcttttgtgatgatcatg

SEQ ID NO: 563484 - DNA, 22 bp, Homo sapiens
taggtcacccgtttgactatcc

SEQ ID NO: 563485 - DNA, 22 bp, Homo sapiens
tctttgccccatcgtggttgca

SEQ ID NO: 563486 - DNA, 22 bp, Homo sapiens
gggaggagcaggcagaggcagt

SEQ ID NO: 563487 - DNA, 22 bp, Homo sapiens
ccagcctggggactctgccaag

SEQ ID NO: 563488 - DNA, 22 bp, Homo sapiens
ttccagagcctgtggtctccct

SEQ ID NO: 563489 - DNA, 22 bp, Homo sapiens
gggcacagataatggtataggg

SEQ ID NO: 563490 - DNA, 22 bp, Homo sapiens
tcagtacgtggcttcataaagc

SEQ ID NO: 563491 - DNA, 22 bp, Homo sapiens
tgtgcaaagaatttatttggat

SEQ ID NO: 563492 - DNA, 22 bp, Homo sapiens
caaaagactgctcatgggaaga

SEQ ID NO: 563493 - DNA, 22 bp, Homo sapiens
tcctgagctaattaagggtcac

SEQ ID NO: 563494 - DNA, 22 bp, Homo sapiens
gccagtggagagcttaagggac

SEQ ID NO: 563495 - DNA, 22 bp, Homo sapiens
ttgccatgttagatattgattt

SEQ ID NO: 563496 - DNA, 22 bp, Homo sapiens
ttctccagatggcgagactgtg

SEQ ID NO: 563497 - DNA, 22 bp, Homo sapiens
tggggtgtgtcctggtctcagg

SEQ ID NO: 563498 - DNA, 22 bp, Homo sapiens
gatgtggggactgacttctttg

SEQ ID NO: 563499 - DNA, 22 bp, Homo sapiens
tctccagattaccacagaagac

SEQ ID NO: 563500 - DNA, 22 bp, Homo sapiens
gctggtatgcaggcagcctgcc

SEQ ID NO: 563501 - DNA, 22 bp, Homo sapiens
gaacattgtgtgattcagtcag

SEQ ID NO: 563502 - DNA, 22 bp, Homo sapiens
gccctggagctgggagtggcct

SEQ ID NO: 563503 - DNA, 22 bp, Homo sapiens
ttctttgtcagtttacgccatt

SEQ ID NO: 563504 - DNA, 22 bp, Homo sapiens
gtgctggtttcagattgtcgtg

SEQ ID NO: 563505 - DNA, 22 bp, Homo sapiens
tctcccatcagccacttccgtc

SEQ ID NO: 563506 - DNA, 22 bp, Homo sapiens
gccctgtgaagagttgggttcg

SEQ ID NO: 563507 - DNA, 22 bp, Homo sapiens
tgttgacaataaagtctaccat

SEQ ID NO: 563508 - DNA, 22 bp, Homo sapiens
agtctgcaatgacctatagtaa

SEQ ID NO: 563509 - DNA, 22 bp, Homo sapiens
aacagtactcggaggccagact

SEQ ID NO: 563510 - DNA, 22 bp, Homo sapiens
acagtgtctgggtttcagggcc

SEQ ID NO: 563511 - DNA, 22 bp, Homo sapiens
tcctatgcacattagcaatcgc

SEQ ID NO: 563512 - DNA, 22 bp, Homo sapiens
tatatggatattttgagttatt

SEQ ID NO: 563513 - DNA, 22 bp, Homo sapiens
agcggcacccagttgtgcctag

SEQ ID NO: 563514 - DNA, 22 bp, Homo sapiens
tagtccaagcctggatttcagt

SEQ ID NO: 563515 - DNA, 22 bp, Homo sapiens
gaactttgcagcggagacttct

SEQ ID NO: 563516 - DNA, 22 bp, Homo sapiens
aagctgctctgcctgcctggct

SEQ ID NO: 563517 - DNA, 22 bp, Homo sapiens
tgcagccagagcttgagggcaa

SEQ ID NO: 563518 - DNA, 22 bp, Homo sapiens
gagctctgattgttgaggaggg

SEQ ID NO: 563519 - DNA, 22 bp, Homo sapiens
attatttgtgcatatcccatcc

SEQ ID NO: 563520 - DNA, 22 bp, Homo sapiens
tgctaggcactctcatccatac

SEQ ID NO: 563521 - DNA, 22 bp, Homo sapiens
tttggtcatgaatgtcagtgtg

SEQ ID NO: 563522 - DNA, 22 bp, Homo sapiens
tgggggtgcctttcagagtcac

SEQ ID NO: 563523 - DNA, 22 bp, Homo sapiens
gctggagggattggaaggaggc

SEQ ID NO: 563524 - DNA, 22 bp, Homo sapiens
ttggagtctgatttctcctctg

SEQ ID NO: 563525 - DNA, 22 bp, Homo sapiens
tacagatttaattaacatttgc

SEQ ID NO: 563526 - DNA, 22 bp, Homo sapiens
tccccaagctctaaggacttcc

SEQ ID NO: 563527 - DNA, 22 bp, Homo sapiens
ggatccctgcagggcagcttag

SEQ ID NO: 563528 - DNA, 22 bp, Homo sapiens
aagaaggcaattgtctgacata

SEQ ID NO: 563529 - DNA, 22 bp, Homo sapiens
ggctccctggacttctcagatt

SEQ ID NO: 563530 - DNA, 22 bp, Homo sapiens
ctgtgacacagacaccttcaga

SEQ ID NO: 563531 - DNA, 22 bp, Homo sapiens
tggaggaggctctggggctgcc

SEQ ID NO: 563532 - DNA, 22 bp, Homo sapiens
tatctgtcaggtactgtctgag

SEQ ID NO: 563533 - DNA, 22 bp, Homo sapiens
tttgtggtcctatcttctagcc

SEQ ID NO: 563534 - DNA, 22 bp, Homo sapiens
tcaacaaaggctgcctctgttt

SEQ ID NO: 563535 - DNA, 22 bp, Homo sapiens
tgtgtgtgggaggcacttgcac

SEQ ID NO: 563536 - DNA, 22 bp, Homo sapiens
tggtgatcaggtctgaacaggg

SEQ ID NO: 563537 - DNA, 22 bp, Homo sapiens
cagcaacgtccttccccacccc

SEQ ID NO: 563538 - DNA, 22 bp, Homo sapiens
acttgcccagggaagttagaag

SEQ ID NO: 563539 - DNA, 22 bp, Homo sapiens
gctctaccaccactagaagaac

SEQ ID NO: 563540 - DNA, 22 bp, Homo sapiens
gcatgggcaaggccatgcagct

SEQ ID NO: 563541 - DNA, 22 bp, Homo sapiens
ttccccttctctgctttgttgt

SEQ ID NO: 563542 - DNA, 22 bp, Homo sapiens
tgactgagtttgtgaagggctg

SEQ ID NO: 563543 - DNA, 22 bp, Homo sapiens
ctgtgcgggggctctgtgatgc

SEQ ID NO: 563544 - DNA, 22 bp, Homo sapiens
ctgatgaatccccaaactcctg

SEQ ID NO: 563545 - DNA, 22 bp, Homo sapiens
tagagctccacctccctcaggg

SEQ ID NO: 563546 - DNA, 22 bp, Homo sapiens
ttctagtggggggtagatgtca

SEQ ID NO: 563547 - DNA, 22 bp, Homo sapiens
tccatctcttcctagaagtgct

SEQ ID NO: 563548 - DNA, 22 bp, Homo sapiens
gcacatgcttctctggtgtccc

SEQ ID NO: 563549 - DNA, 22 bp, Homo sapiens
ttttattgctactgttcattga

SEQ ID NO: 563550 - DNA, 22 bp, Homo sapiens
ttcaaacaaaactgttcccata

SEQ ID NO: 563551 - DNA, 22 bp, Homo sapiens
ttactgctagacaaatggcttt

SEQ ID NO: 563552 - DNA, 22 bp, Homo sapiens
tgtagtcatgtgtattatgaat

SEQ ID NO: 563553 - DNA, 22 bp, Homo sapiens
atctacagtgatcacaaggcga

SEQ ID NO: 563554 - DNA, 22 bp, Homo sapiens
tccttcaatgggaaaagccagg

SEQ ID NO: 563555 - DNA, 22 bp, Homo sapiens
ttgcgggtgggggagaagggag

SEQ ID NO: 563556 - DNA, 22 bp, Homo sapiens
tggcacataataaatgctatgt

SEQ ID NO: 563557 - DNA, 22 bp, Homo sapiens
actagagagtaggttccctggt

SEQ ID NO: 563558 - DNA, 22 bp, Homo sapiens
tgactgggtaacagtattagag

SEQ ID NO: 563559 - DNA, 22 bp, Homo sapiens
tagtagaattccaatatagcgt

SEQ ID NO: 563560 - DNA, 22 bp, Homo sapiens
aattaaaaagtcagattcagaa

SEQ ID NO: 563561 - DNA, 22 bp, Homo sapiens
ttgttgtacttttttttttgtt

SEQ ID NO: 563562 - DNA, 22 bp, Homo sapiens
gcccctcacatgcagaggtttc

SEQ ID NO: 563563 - DNA, 22 bp, Homo sapiens
caaatcagacccctccaatctt

SEQ ID NO: 563564 - DNA, 22 bp, Homo sapiens
gtgaatgggcctgattgtctag

SEQ ID NO: 563565 - DNA, 22 bp, Homo sapiens
cctgatttgattctgggatctc

SEQ ID NO: 563566 - DNA, 22 bp, Homo sapiens
tgatgggggttggggcgatggc

SEQ ID NO: 563567 - DNA, 22 bp, Homo sapiens
agtaatctcaattgtgaaatag

SEQ ID NO: 563568 - DNA, 22 bp, Homo sapiens
accctctgcatcagcttcttta

SEQ ID NO: 563569 - DNA, 22 bp, Homo sapiens
tcgggccttcgtcacctgtgtc

SEQ ID NO: 563570 - DNA, 22 bp, Homo sapiens
aatctgagcagaagtaaggttt

SEQ ID NO: 563571 - DNA, 22 bp, Homo sapiens
taaagtcagcttgcagttatat

SEQ ID NO: 563572 - DNA, 22 bp, Homo sapiens
agcttggtgcctgtcatcactg

SEQ ID NO: 563573 - DNA, 22 bp, Homo sapiens
tagaaacaggcaggactgggag

SEQ ID NO: 563574 - DNA, 22 bp, Homo sapiens
ttgatagtttccctcttgttgc

SEQ ID NO: 563575 - DNA, 22 bp, Homo sapiens
ggagaaggcttggagtgttcca

SEQ ID NO: 563576 - DNA, 22 bp, Homo sapiens
ttttctggaaggggagacagag

SEQ ID NO: 563577 - DNA, 22 bp, Homo sapiens
ctcagcagggtgaaggggattt

SEQ ID NO: 563578 - DNA, 22 bp, Homo sapiens
gaagcaggttcttcaggatgaa

SEQ ID NO: 563579 - DNA, 22 bp, Homo sapiens
agtgttctggaaaattgcttct

SEQ ID NO: 563580 - DNA, 22 bp, Homo sapiens
ttttgctgtttgggagtgtttt

SEQ ID NO: 563581 - DNA, 22 bp, Homo sapiens
agtgctcgtaggtgttatgatg

SEQ ID NO: 563582 - DNA, 22 bp, Homo sapiens
ttctcctttaggcttctttgtt

SEQ ID NO: 563583 - DNA, 22 bp, Homo sapiens
aagaagagaggtaggaagcaag

SEQ ID NO: 563584 - DNA, 22 bp, Homo sapiens
tgcatctgtcatacagaaattg

SEQ ID NO: 563585 - DNA, 22 bp, Homo sapiens
ttttatggtgcttttttgaagt

SEQ ID NO: 563586 - DNA, 22 bp, Homo sapiens
atatcagctgccacaggacttt

SEQ ID NO: 563587 - DNA, 22 bp, Homo sapiens
tgctgggaagtgggaaaagggg

SEQ ID NO: 563588 - DNA, 22 bp, Homo sapiens
gctggactacagctgtgtgttt

SEQ ID NO: 563589 - DNA, 22 bp, Homo sapiens
tcctgccgtagaaatgttggtg

SEQ ID NO: 563590 - DNA, 22 bp, Homo sapiens
atgtacatcatgataaattaag

SEQ ID NO: 563591 - DNA, 22 bp, Homo sapiens
taatttgaaagcagattttgga

SEQ ID NO: 563592 - DNA, 22 bp, Homo sapiens
tgaatcaagatgtatcgactct

SEQ ID NO: 563593 - DNA, 22 bp, Homo sapiens
cagtgtggcttatgggaagtcc

SEQ ID NO: 563594 - DNA, 22 bp, Homo sapiens
cccccatccatctttccacctc

SEQ ID NO: 563595 - DNA, 22 bp, Homo sapiens
tgagcttgaatgtatgtaatag

SEQ ID NO: 563596 - DNA, 22 bp, Homo sapiens
ttccggggcccggtagaggcgc

SEQ ID NO: 563597 - DNA, 22 bp, Homo sapiens
tctgttctctccacatgtcagc

SEQ ID NO: 563598 - DNA, 22 bp, Homo sapiens
actgtcgattatgatgagtcag

SEQ ID NO: 563599 - DNA, 22 bp, Homo sapiens
ttgcattgatttgtgtctcaca

SEQ ID NO: 563600 - DNA, 22 bp, Homo sapiens
tgtggtttggagtttgaagaca

SEQ ID NO: 563601 - DNA, 22 bp, Homo sapiens
tgaggaaagatttcagtcagct

SEQ ID NO: 563602 - DNA, 22 bp, Homo sapiens
tctcctggggtttggggtgggt

SEQ ID NO: 563603 - DNA, 22 bp, Homo sapiens
ttggtcggtccttaggctgcgc

SEQ ID NO: 563604 - DNA, 22 bp, Homo sapiens
ttctggaaactgaaatgggaca

SEQ ID NO: 563605 - DNA, 22 bp, Homo sapiens
tggccatttcctgatacctgtg

SEQ ID NO: 563606 - DNA, 22 bp, Homo sapiens
tgtgcaacttgcctttggggga

SEQ ID NO: 563607 - DNA, 22 bp, Homo sapiens
gatggtggcggccccagggagg

SEQ ID NO: 563608 - DNA, 22 bp, Homo sapiens
tgagactggggcgtgaggctgt

SEQ ID NO: 563609 - DNA, 22 bp, Homo sapiens
ttccattatcttcctctgccct

SEQ ID NO: 563610 - DNA, 22 bp, Homo sapiens
tcagttgtcatggtaacatgat

SEQ ID NO: 563611 - DNA, 22 bp, Homo sapiens
gggtcccacctgctcctgtagg

SEQ ID NO: 563612 - DNA, 22 bp, Homo sapiens
tccagttcaaaacttctctgtt

SEQ ID NO: 563613 - DNA, 22 bp, Homo sapiens
tcaatgtttacattgaaggaca

SEQ ID NO: 563614 - DNA, 22 bp, Homo sapiens
tacagtaaaagacagggttgga

SEQ ID NO: 563615 - DNA, 22 bp, Homo sapiens
gctattatagtctctcaagaat

SEQ ID NO: 563616 - DNA, 22 bp, Homo sapiens
tgagatagagtgtagtgtctgg

SEQ ID NO: 563617 - DNA, 22 bp, Homo sapiens
tggttctggggaagggggttgg

SEQ ID NO: 563618 - DNA, 22 bp, Homo sapiens
gggaggcacaggaggatgccta

SEQ ID NO: 563619 - DNA, 22 bp, Homo sapiens
tgtccccagaagggtctcaggc

SEQ ID NO: 563620 - DNA, 22 bp, Homo sapiens
cgcccctgctggctcagtcctc

SEQ ID NO: 563621 - DNA, 22 bp, Homo sapiens
agaggcagtcctcggagcccaa

SEQ ID NO: 563622 - DNA, 22 bp, Homo sapiens
caaatttaggtaacagtctgta

SEQ ID NO: 563623 - DNA, 22 bp, Homo sapiens
tgtgcttcttcaagctggtctg

SEQ ID NO: 563624 - DNA, 22 bp, Homo sapiens
taattaaatctcttcaagcttt

SEQ ID NO: 563625 - DNA, 22 bp, Homo sapiens
tctccttggtctcgttccaggc

SEQ ID NO: 563626 - DNA, 22 bp, Homo sapiens
tcctgctgagcagcacgcctgc

SEQ ID NO: 563627 - DNA, 22 bp, Homo sapiens
tggttggtaatcactgctgatg

SEQ ID NO: 563628 - DNA, 22 bp, Homo sapiens
tgctgaattcgtcctcctgggc

SEQ ID NO: 563629 - DNA, 22 bp, Homo sapiens
tcatctaaaaggggaatccctt

SEQ ID NO: 563630 - DNA, 22 bp, Homo sapiens
gctgcggacaacatggacccaa

SEQ ID NO: 563631 - DNA, 22 bp, Homo sapiens
tttgttcagtgacttctatctt

SEQ ID NO: 563632 - DNA, 22 bp, Homo sapiens
ttcggccctgacccttggaggc

SEQ ID NO: 563633 - DNA, 22 bp, Homo sapiens
cctttctgtgtggaggccacgt

SEQ ID NO: 563634 - DNA, 22 bp, Homo sapiens
tgactcttatctacaggacact

SEQ ID NO: 563635 - DNA, 22 bp, Homo sapiens
ggacgccgaggagctgaagagt

SEQ ID NO: 563636 - DNA, 22 bp, Homo sapiens
gggatggtctaggggatcctgt

SEQ ID NO: 563637 - DNA, 22 bp, Homo sapiens
ccaaggttttgtgaactgtgtc

SEQ ID NO: 563638 - DNA, 22 bp, Homo sapiens
tccgcagggataggggatgccc

SEQ ID NO: 563639 - DNA, 22 bp, Homo sapiens
atgggagctgagcttgtcccag

SEQ ID NO: 563640 - DNA, 22 bp, Homo sapiens
tctggggatatgtgttcagagt

SEQ ID NO: 563641 - DNA, 22 bp, Homo sapiens
gacctctgctatagcactgtca

SEQ ID NO: 563642 - DNA, 22 bp, Homo sapiens
ggccaggggccaggggaggggg

SEQ ID NO: 563643 - DNA, 22 bp, Homo sapiens
acgcagggcgggaggcgatgga

SEQ ID NO: 563644 - DNA, 22 bp, Homo sapiens
agaaacagatagaatcctttgc

SEQ ID NO: 563645 - DNA, 22 bp, Homo sapiens
agaatcatatttctctctgtgc

SEQ ID NO: 563646 - DNA, 22 bp, Homo sapiens
cgcttccggggcatggccagga

SEQ ID NO: 563647 - DNA, 22 bp, Homo sapiens
aggtagactgaagttctgtcat

SEQ ID NO: 563648 - DNA, 22 bp, Homo sapiens
ggaagaaccagagggaggtaat

SEQ ID NO: 563649 - DNA, 22 bp, Homo sapiens
taggcagtagcttgagttataa

SEQ ID NO: 563650 - DNA, 22 bp, Homo sapiens
gagccctcttccctagtgatcg

SEQ ID NO: 563651 - DNA, 22 bp, Homo sapiens
atttggtggggttttttaatgt

SEQ ID NO: 563652 - DNA, 22 bp, Homo sapiens
tgtgtgctaactcagtctttac

SEQ ID NO: 563653 - DNA, 22 bp, Homo sapiens
tccccgaatcccagcctgtttt

SEQ ID NO: 563654 - DNA, 22 bp, Homo sapiens
ccccagaaggcaggtcctgggg

SEQ ID NO: 563655 - DNA, 22 bp, Homo sapiens
tggtttttgacattgatataca

SEQ ID NO: 563656 - DNA, 22 bp, Homo sapiens
tacagggtaggggccaggaatt

SEQ ID NO: 563657 - DNA, 22 bp, Homo sapiens
agccatgtgttccacaggcctc

SEQ ID NO: 563658 - DNA, 22 bp, Homo sapiens
gagttggggcctgactgtccta

SEQ ID NO: 563659 - DNA, 22 bp, Homo sapiens
acatatataggaacagcactcc

SEQ ID NO: 563660 - DNA, 22 bp, Homo sapiens
gcaaccagatcagcttttgaga

SEQ ID NO: 563661 - DNA, 22 bp, Homo sapiens
tcctctcccttgtctcctacat

SEQ ID NO: 563662 - DNA, 22 bp, Homo sapiens
tcatccctggattggtcacctc

SEQ ID NO: 563663 - DNA, 22 bp, Homo sapiens
gaaggtgggcagttctggaatg

SEQ ID NO: 563664 - DNA, 22 bp, Homo sapiens
tggatggagaaaggctgccact

SEQ ID NO: 563665 - DNA, 22 bp, Homo sapiens
tgatgagggcctggtggctgtg

SEQ ID NO: 563666 - DNA, 22 bp, Homo sapiens
gcaagcctcatttccgtctttg

SEQ ID NO: 563667 - DNA, 22 bp, Homo sapiens
ggaggtttacaatgtatagttt

SEQ ID NO: 563668 - DNA, 22 bp, Homo sapiens
gctgaacacatttctgtcacta

SEQ ID NO: 563669 - DNA, 22 bp, Homo sapiens
tcttctacactgagttttttcc

SEQ ID NO: 563670 - DNA, 22 bp, Homo sapiens
gagtgacagagtgacattttct

SEQ ID NO: 563671 - DNA, 22 bp, Homo sapiens
aggcttgggtcagaaggcttgt

SEQ ID NO: 563672 - DNA, 22 bp, Homo sapiens
agtgtgtttgttcatgccagag

SEQ ID NO: 563673 - DNA, 22 bp, Homo sapiens
ttaatcaccatggatgtatgat

SEQ ID NO: 563674 - DNA, 22 bp, Homo sapiens
acgatgcaaattgccataaagt

SEQ ID NO: 563675 - DNA, 22 bp, Homo sapiens
tgcttaccctccctgcagtaag

SEQ ID NO: 563676 - DNA, 22 bp, Homo sapiens
ccctgtctcactatgttaagtg

SEQ ID NO: 563677 - DNA, 22 bp, Homo sapiens
tggaccggacatatagatttgg

SEQ ID NO: 563678 - DNA, 22 bp, Homo sapiens
taagaatatgtttgacatttag

SEQ ID NO: 563679 - DNA, 22 bp, Homo sapiens
ttgaacagggtgggggaatgga

SEQ ID NO: 563680 - DNA, 22 bp, Homo sapiens
tttggcagctgctccagatgct

SEQ ID NO: 563681 - DNA, 22 bp, Homo sapiens
gtcgtcctggctgtgggctact

SEQ ID NO: 563682 - DNA, 22 bp, Homo sapiens
gactgatggtttctggtctgag

SEQ ID NO: 563683 - DNA, 22 bp, Homo sapiens
gcagaaaaatgttgaggtttca

SEQ ID NO: 563684 - DNA, 22 bp, Homo sapiens
gaggacagggggctttttaatt

SEQ ID NO: 563685 - DNA, 22 bp, Homo sapiens
tgtttttaacctcccaagggtg

SEQ ID NO: 563686 - DNA, 22 bp, Homo sapiens
ttcactggtggcccattcaaat

SEQ ID NO: 563687 - DNA, 22 bp, Homo sapiens
tccaagactgaaatcaaggtca

SEQ ID NO: 563688 - DNA, 22 bp, Homo sapiens
acttattgagcgccaactctgt

SEQ ID NO: 563689 - DNA, 22 bp, Homo sapiens
cgggccaggcggcccgggagca

SEQ ID NO: 563690 - DNA, 22 bp, Homo sapiens
tgaggcccagcattcagggcag

SEQ ID NO: 563691 - DNA, 22 bp, Homo sapiens
gcatgcagtgacagcagttggg

SEQ ID NO: 563692 - DNA, 22 bp, Homo sapiens
ttagtgtaccagagtatgccat

SEQ ID NO: 563693 - DNA, 22 bp, Homo sapiens
ttggcccaggtcccagagagtc

SEQ ID NO: 563694 - DNA, 22 bp, Homo sapiens
tatctttcctttgtgtgtgatg

SEQ ID NO: 563695 - DNA, 22 bp, Homo sapiens
taaagtgcaggtataacacctc

SEQ ID NO: 563696 - DNA, 22 bp, Homo sapiens
tttcctgtctttagctgtaggg

SEQ ID NO: 563697 - DNA, 22 bp, Homo sapiens
taatcatattctagtggtgcta

SEQ ID NO: 563698 - DNA, 22 bp, Homo sapiens
ggctgctgcccggctgggctcg

SEQ ID NO: 563699 - DNA, 22 bp, Homo sapiens
ttcattgttgtcggtgggttgt

SEQ ID NO: 563700 - DNA, 22 bp, Homo sapiens
aatgtgaccaaaatacatacac

SEQ ID NO: 563701 - DNA, 22 bp, Homo sapiens
taacatatttttctcagtaaag

SEQ ID NO: 563702 - DNA, 22 bp, Homo sapiens
gagggaaggaatggggagagag

SEQ ID NO: 563703 - DNA, 22 bp, Homo sapiens
caaagctggcaagaatccatag

SEQ ID NO: 563704 - DNA, 22 bp, Homo sapiens
ctgcaaactgggacactattca

SEQ ID NO: 563705 - DNA, 22 bp, Homo sapiens
tgtctgtctgtccacactcacc

SEQ ID NO: 563706 - DNA, 22 bp, Homo sapiens
ggatgggaggcaggaccctggc

SEQ ID NO: 563707 - DNA, 22 bp, Homo sapiens
ctctctgtgccctgtgctggcc

SEQ ID NO: 563708 - DNA, 22 bp, Homo sapiens
aactggttgtgttagaagctgc

SEQ ID NO: 563709 - DNA, 22 bp, Homo sapiens
acggccgactgccagccatggg

SEQ ID NO: 563710 - DNA, 22 bp, Homo sapiens
ccctcggctcgcctggcccaga

SEQ ID NO: 563711 - DNA, 22 bp, Homo sapiens
ctcttgtctcaatcctcctcgt

SEQ ID NO: 563712 - DNA, 22 bp, Homo sapiens
ttaatgaaatctagtataaacg

SEQ ID NO: 563713 - DNA, 22 bp, Homo sapiens
cgctaggctgcgtctgaaagcg

SEQ ID NO: 563714 - DNA, 22 bp, Homo sapiens
ttccttgtttatgtccttggcc

SEQ ID NO: 563715 - DNA, 22 bp, Homo sapiens
gggcatttgttggaagtagaag

SEQ ID NO: 563716 - DNA, 22 bp, Homo sapiens
tcacgccaggaggaaaaatagt

SEQ ID NO: 563717 - DNA, 22 bp, Homo sapiens
taggagcatgtgtgggggtgtg

SEQ ID NO: 563718 - DNA, 22 bp, Homo sapiens
tggccgctctgcctccacatcc

SEQ ID NO: 563719 - DNA, 22 bp, Homo sapiens
gcaagtgcctgctgacaggtgg

SEQ ID NO: 563720 - DNA, 22 bp, Homo sapiens
tcattctcattccaagacgttt

SEQ ID NO: 563721 - DNA, 22 bp, Homo sapiens
ggcctcctcctgattctccagc

SEQ ID NO: 563722 - DNA, 22 bp, Homo sapiens
agcttcagagcacatctgttca

SEQ ID NO: 563723 - DNA, 22 bp, Homo sapiens
tcactcctcttccttttaattg

SEQ ID NO: 563724 - DNA, 22 bp, Homo sapiens
tggtggtttacaaagtaattca

SEQ ID NO: 563725 - DNA, 22 bp, Homo sapiens
taggtacctcagggcagtgttc

SEQ ID NO: 563726 - DNA, 22 bp, Homo sapiens
tttgtgggggatctctgcctgc

SEQ ID NO: 563727 - DNA, 22 bp, Homo sapiens
ccgagttttcaggacttcaggg

SEQ ID NO: 563728 - DNA, 22 bp, Homo sapiens
aataacaaaaggaccttgttct

SEQ ID NO: 563729 - DNA, 22 bp, Homo sapiens
tgtggcagggggaattgagagg

SEQ ID NO: 563730 - DNA, 22 bp, Homo sapiens
actttgccttgcttttcctggt

SEQ ID NO: 563731 - DNA, 22 bp, Homo sapiens
ttcacaaaactcatagagtgct

SEQ ID NO: 563732 - DNA, 22 bp, Homo sapiens
tctgttcccccctcccgcccag

SEQ ID NO: 563733 - DNA, 22 bp, Homo sapiens
tattgcactaatatatcactgg

SEQ ID NO: 563734 - DNA, 22 bp, Homo sapiens
tgctgtagcctgcaaggtccta

SEQ ID NO: 563735 - DNA, 22 bp, Homo sapiens
tggcttggcaggaggaagacct

SEQ ID NO: 563736 - DNA, 22 bp, Homo sapiens
tccatccatgctctactgtcaa

SEQ ID NO: 563737 - DNA, 22 bp, Homo sapiens
taattttttcacactggcaccc

SEQ ID NO: 563738 - DNA, 22 bp, Homo sapiens
ggggtaggtgtgagagacccag

SEQ ID NO: 563739 - DNA, 22 bp, Homo sapiens
cactcttccccttaccagaatc

SEQ ID NO: 563740 - DNA, 22 bp, Homo sapiens
actggagagcaatcagttgttc

SEQ ID NO: 563741 - DNA, 22 bp, Homo sapiens
aggctgctggtgtccaggggaa

SEQ ID NO: 563742 - DNA, 22 bp, Homo sapiens
tgtgcacatgtacgcagatatg

SEQ ID NO: 563743 - DNA, 22 bp, Homo sapiens
aaatacttactgcttgcctgct

SEQ ID NO: 563744 - DNA, 22 bp, Homo sapiens
tgactccttctccaggagctgt

SEQ ID NO: 563745 - DNA, 22 bp, Homo sapiens
aaagaacctgggccgatagtta

SEQ ID NO: 563746 - DNA, 22 bp, Homo sapiens
cagaagatttcctttaactacc

SEQ ID NO: 563747 - DNA, 22 bp, Homo sapiens
ggccctctcagggccctaggag

SEQ ID NO: 563748 - DNA, 22 bp, Homo sapiens
gagaagccgttgttctccatcc

SEQ ID NO: 563749 - DNA, 22 bp, Homo sapiens
gtgctacgtatcctccatagca

SEQ ID NO: 563750 - DNA, 22 bp, Homo sapiens
tcaaaggagccccagtgctact

SEQ ID NO: 563751 - DNA, 22 bp, Homo sapiens
gctcccggtgtcctgcacacgt

SEQ ID NO: 563752 - DNA, 22 bp, Homo sapiens
gggtgggtggtccgcagacata

SEQ ID NO: 563753 - DNA, 22 bp, Homo sapiens
gtgttttcttttgaaaatgagc

SEQ ID NO: 563754 - DNA, 23 bp, Homo sapiens
tggtgggccgcagaacatgtgct

SEQ ID NO: 563755 - DNA, 22 bp, Homo sapiens
gttagagaaagttaactctgag

SEQ ID NO: 563756 - DNA, 22 bp, Homo sapiens
acagttcacaaaaccttggcct

SEQ ID NO: 563757 - DNA, 22 bp, Homo sapiens
tcatttacttctatgacaacat

SEQ ID NO: 563758 - DNA, 22 bp, Homo sapiens
cctcccccacgtggttgttgct

SEQ ID NO: 563759 - DNA, 22 bp, Homo sapiens
ttggccctctcctgctgggcga

SEQ ID NO: 563760 - DNA, 22 bp, Homo sapiens
ggcaggggcaggaccttcagag

SEQ ID NO: 563761 - DNA, 22 bp, Homo sapiens
tcctctttgatagttggtactt

SEQ ID NO: 563762 - DNA, 22 bp, Homo sapiens
gctgagggggcctgggggcacg

SEQ ID NO: 563763 - DNA, 22 bp, Homo sapiens
agacgtggattgtttcctttag

SEQ ID NO: 563764 - DNA, 22 bp, Homo sapiens
cctgttggggcagtgcagggcc

SEQ ID NO: 563765 - DNA, 22 bp, Homo sapiens
ggctttccctgagggaaggtag

SEQ ID NO: 563766 - DNA, 22 bp, Homo sapiens
gaaatacaaaatgtaaggagac

SEQ ID NO: 563767 - DNA, 22 bp, Homo sapiens
ctgcactggctaaaggctgggt

SEQ ID NO: 563768 - DNA, 22 bp, Homo sapiens
aggaaaggcaagagtggagtct

SEQ ID NO: 563769 - DNA, 22 bp, Homo sapiens
tcgcatggcctccatcccctcc

SEQ ID NO: 563770 - DNA, 22 bp, Homo sapiens
gctccaaagtcggggcgggttg

SEQ ID NO: 563771 - DNA, 22 bp, Homo sapiens
tgctagagtccatcagttaagc

SEQ ID NO: 563772 - DNA, 22 bp, Homo sapiens
tgctcctggtaccatgtcctgt

SEQ ID NO: 563773 - DNA, 22 bp, Homo sapiens
tcctttttctttccctcctccc

SEQ ID NO: 563774 - DNA, 22 bp, Homo sapiens
tcatatttttatcacaataacc

SEQ ID NO: 563775 - DNA, 22 bp, Homo sapiens
tttgcatggacaggcacagagg

SEQ ID NO: 563776 - DNA, 22 bp, Homo sapiens
tccaggtgggttcccgactctg

SEQ ID NO: 563777 - DNA, 22 bp, Homo sapiens
tgatgaattcaaggtattcaca

SEQ ID NO: 563778 - DNA, 22 bp, Homo sapiens
ccaggtggaacaggccgtcctg

SEQ ID NO: 563779 - DNA, 22 bp, Homo sapiens
ggttccttatctgttcacaatc

SEQ ID NO: 563780 - DNA, 22 bp, Homo sapiens
tctatctttccttcttgtgtct

SEQ ID NO: 563781 - DNA, 22 bp, Homo sapiens
tagaggaaaagtccctgagcat

SEQ ID NO: 563782 - DNA, 22 bp, Homo sapiens
gtggcaggtgggtctgaggctg

SEQ ID NO: 563783 - DNA, 22 bp, Homo sapiens
tatgttggagtgagttggagcc

SEQ ID NO: 563784 - DNA, 22 bp, Homo sapiens
tatttagatagataggcttaac

SEQ ID NO: 563785 - DNA, 22 bp, Homo sapiens
tcagctgcctggagtgggtgag

SEQ ID NO: 563786 - DNA, 22 bp, Homo sapiens
tcttgtatctggaaagaggcat

SEQ ID NO: 563787 - DNA, 22 bp, Homo sapiens
agacctgtctataaaagtgaat

SEQ ID NO: 563788 - DNA, 22 bp, Homo sapiens
attccatttgcctgctgagtga

SEQ ID NO: 563789 - DNA, 22 bp, Homo sapiens
tagggagagagttttgagtctt

SEQ ID NO: 563790 - DNA, 22 bp, Homo sapiens
agccgggatgggaaggctggga

SEQ ID NO: 563791 - DNA, 22 bp, Homo sapiens
tcctggtagtgtgcccatgggg

SEQ ID NO: 563792 - DNA, 22 bp, Homo sapiens
gctggagttctccaaaggactt

SEQ ID NO: 563793 - DNA, 22 bp, Homo sapiens
tgttaaaaaactgtatcttcag

SEQ ID NO: 563794 - DNA, 22 bp, Homo sapiens
aaagaaacactttgatttgaaa

SEQ ID NO: 563795 - DNA, 22 bp, Homo sapiens
cacctcagccatgtggaggagg

SEQ ID NO: 563796 - DNA, 22 bp, Homo sapiens
ggactgaatctgctgagccagc

SEQ ID NO: 563797 - DNA, 22 bp, Homo sapiens
aatttagtgcctctgcgtctct

SEQ ID NO: 563798 - DNA, 22 bp, Homo sapiens
cttgtctccatggaaatgaaaa

SEQ ID NO: 563799 - DNA, 22 bp, Homo sapiens
tggatcagtggccaccacggag

SEQ ID NO: 563800 - DNA, 22 bp, Homo sapiens
ttgccttccaaaacccctatct

SEQ ID NO: 563801 - DNA, 22 bp, Homo sapiens
cctattcctaaatgtgctccag

SEQ ID NO: 563802 - DNA, 22 bp, Homo sapiens
ttcccagagggctaggcgccgc

SEQ ID NO: 563803 - DNA, 22 bp, Homo sapiens
cggctttggagattatggggaa

SEQ ID NO: 563804 - DNA, 22 bp, Homo sapiens
caaaaaaaaaagcccaaccctt

SEQ ID NO: 563805 - DNA, 22 bp, Homo sapiens
tctctcgtggaactgacatcca

SEQ ID NO: 563806 - DNA, 22 bp, Homo sapiens
tgggtagctctggtctaatgcc

SEQ ID NO: 563807 - DNA, 22 bp, Homo sapiens
tgctctatacctgggtttgttc

SEQ ID NO: 563808 - DNA, 22 bp, Homo sapiens
aatcctgaagcttaatttttgc

SEQ ID NO: 563809 - DNA, 22 bp, Homo sapiens
tgttggccactggtcctgttat

SEQ ID NO: 563810 - DNA, 22 bp, Homo sapiens
tagatggctttgaatgtgtgag

SEQ ID NO: 563811 - DNA, 22 bp, Homo sapiens
tcacctccctcccctctcatcc

SEQ ID NO: 563812 - DNA, 22 bp, Homo sapiens
tttatgtcatcagcagaaaacc

SEQ ID NO: 563813 - DNA, 22 bp, Homo sapiens
aaggtggtgattaggttttcag

SEQ ID NO: 563814 - DNA, 22 bp, Homo sapiens
tcactcagatatattagggtta

SEQ ID NO: 563815 - DNA, 22 bp, Homo sapiens
agctgtaaacggcttcttcctc

SEQ ID NO: 563816 - DNA, 22 bp, Homo sapiens
gtctggggatcttagtttgaga

SEQ ID NO: 563817 - DNA, 22 bp, Homo sapiens
cagtaggggccattggtaaagt

SEQ ID NO: 563818 - DNA, 22 bp, Homo sapiens
atctgcatggttgggctttctg

SEQ ID NO: 563819 - DNA, 22 bp, Homo sapiens
agaagggggatgcctaccttga

SEQ ID NO: 563820 - DNA, 22 bp, Homo sapiens
gtcttttgcccttccagctctt

SEQ ID NO: 563821 - DNA, 22 bp, Homo sapiens
tctgtgtcttccttccctgagg

SEQ ID NO: 563822 - DNA, 22 bp, Homo sapiens
tataatagacatgatcaaataa

SEQ ID NO: 563823 - DNA, 22 bp, Homo sapiens
tgtgttcgtggccatgtgttta

SEQ ID NO: 563824 - DNA, 22 bp, Homo sapiens
agtaagttgccttgtatttgta

SEQ ID NO: 563825 - DNA, 22 bp, Homo sapiens
tcttgcttaagccataaatttt

SEQ ID NO: 563826 - DNA, 22 bp, Homo sapiens
ttttcatagcctgaggaaggcc

SEQ ID NO: 563827 - DNA, 22 bp, Homo sapiens
ggtagaagaaattagcataaat

SEQ ID NO: 563828 - DNA, 22 bp, Homo sapiens
gctggaactcaagtgaacacat

SEQ ID NO: 563829 - DNA, 22 bp, Homo sapiens
cagcttggctaaagtgataggc

SEQ ID NO: 563830 - DNA, 22 bp, Homo sapiens
tccctggcacaaaggggctttg

SEQ ID NO: 563831 - DNA, 22 bp, Homo sapiens
atccgactcccctgtgctcagt

SEQ ID NO: 563832 - DNA, 22 bp, Homo sapiens
cgtggattttcctctatgatta

SEQ ID NO: 563833 - DNA, 22 bp, Homo sapiens
tgtttgcagaggaaactgagac

SEQ ID NO: 563834 - DNA, 22 bp, Homo sapiens
attgtgctggtgataactatag

SEQ ID NO: 563835 - DNA, 22 bp, Homo sapiens
ctttgctttctcttgctctctc

SEQ ID NO: 563836 - DNA, 22 bp, Homo sapiens
ggccggacaggcggaccccaca

SEQ ID NO: 563837 - DNA, 22 bp, Homo sapiens
tagtatcccagtttgcagccaa

SEQ ID NO: 563838 - DNA, 22 bp, Homo sapiens
tgctgctctgagttagcttgac

SEQ ID NO: 563839 - DNA, 22 bp, Homo sapiens
tgcaagctccttacatccacag

SEQ ID NO: 563840 - DNA, 22 bp, Homo sapiens
ttctctttccttctgggctcca

SEQ ID NO: 563841 - DNA, 22 bp, Homo sapiens
gccagttcccattgtagaatgc

SEQ ID NO: 563842 - DNA, 22 bp, Homo sapiens
tattgatcacgtcaattatagc

SEQ ID NO: 563843 - DNA, 22 bp, Homo sapiens
agcctgggccaccacaggggaa

SEQ ID NO: 563844 - DNA, 22 bp, Homo sapiens
tgctggttttctatgaatatat

SEQ ID NO: 563845 - DNA, 22 bp, Homo sapiens
tcatgagccatgattagcctca

SEQ ID NO: 563846 - DNA, 22 bp, Homo sapiens
gggactggtgaattgcaagtgt

SEQ ID NO: 563847 - DNA, 22 bp, Homo sapiens
taaattcctggcatttctgctt

SEQ ID NO: 563848 - DNA, 22 bp, Homo sapiens
tctgaaattggctggttcccat

SEQ ID NO: 563849 - DNA, 22 bp, Homo sapiens
agtctcctgaagaagaggcaga

SEQ ID NO: 563850 - DNA, 22 bp, Homo sapiens
ggaatgttggcaggagaagatg

SEQ ID NO: 563851 - DNA, 22 bp, Homo sapiens
taccctgcccttttcacaagat

SEQ ID NO: 563852 - DNA, 22 bp, Homo sapiens
aaaaatgctttgagtaaatgcc

SEQ ID NO: 563853 - DNA, 22 bp, Homo sapiens
ttgtacaggaataaaaggaata

SEQ ID NO: 563854 - DNA, 22 bp, Homo sapiens
tggccattcaccagctcctcag

SEQ ID NO: 563855 - DNA, 22 bp, Homo sapiens
ctgggggctgggctgggaggac

SEQ ID NO: 563856 - DNA, 22 bp, Homo sapiens
gcttggctggggcccagccagg

SEQ ID NO: 563857 - DNA, 22 bp, Homo sapiens
tttaaagagtctcttgtctgcc

SEQ ID NO: 563858 - DNA, 22 bp, Homo sapiens
ccatgaaaaatgctatgttgta

SEQ ID NO: 563859 - DNA, 22 bp, Homo sapiens
atacattcctgaaggtaatgag

SEQ ID NO: 563860 - DNA, 22 bp, Homo sapiens
tggcttcgagcctttgccctga

SEQ ID NO: 563861 - DNA, 22 bp, Homo sapiens
tgagtaggacctaagggtctgc

SEQ ID NO: 563862 - DNA, 22 bp, Homo sapiens
gaagcttttaaaatgctgtgaa

SEQ ID NO: 563863 - DNA, 22 bp, Homo sapiens
tgaatagtgttgagattgagaa

SEQ ID NO: 563864 - DNA, 22 bp, Homo sapiens
tcaatgtcagaagagaattgga

SEQ ID NO: 563865 - DNA, 22 bp, Homo sapiens
tatggacataactggggcgctg

SEQ ID NO: 563866 - DNA, 22 bp, Homo sapiens
tgtcttggtacctctttgaagt

SEQ ID NO: 563867 - DNA, 22 bp, Homo sapiens
ccatcccaactgtgtgcttgcc

SEQ ID NO: 563868 - DNA, 22 bp, Homo sapiens
tgaagtgggggctctgaagggc

SEQ ID NO: 563869 - DNA, 22 bp, Homo sapiens
gtcccaggcagcccttggtctt

SEQ ID NO: 563870 - DNA, 22 bp, Homo sapiens
tgaccaggggagagcagaagga

SEQ ID NO: 563871 - DNA, 22 bp, Homo sapiens
gtcctgtctgggtggggctgcc

SEQ ID NO: 563872 - DNA, 22 bp, Homo sapiens
taagtaggctggttgattagga

SEQ ID NO: 563873 - DNA, 22 bp, Homo sapiens
ggtagttatcttgaggtaggtg

SEQ ID NO: 563874 - DNA, 22 bp, Homo sapiens
tcattagcattcttgaacgtgc

SEQ ID NO: 563875 - DNA, 22 bp, Homo sapiens
tggacagggctgagagcccttg

SEQ ID NO: 563876 - DNA, 22 bp, Homo sapiens
ctggccctccttccagataccc

SEQ ID NO: 563877 - DNA, 22 bp, Homo sapiens
gcgaggggagggcccagcccct

SEQ ID NO: 563878 - DNA, 22 bp, Homo sapiens
ggggcctgggagggagggcgcc

SEQ ID NO: 563879 - DNA, 22 bp, Homo sapiens
tggttagggggcgggaagggcg

SEQ ID NO: 563880 - DNA, 22 bp, Homo sapiens
tatatgcatgtgtgagtgcgct

SEQ ID NO: 563881 - DNA, 22 bp, Homo sapiens
acatcctccagtggtgcaactc

SEQ ID NO: 563882 - DNA, 22 bp, Homo sapiens
tattaaatccaggtaatagagg

SEQ ID NO: 563883 - DNA, 22 bp, Homo sapiens
ttctcattctgggtctctttcc

SEQ ID NO: 563884 - DNA, 22 bp, Homo sapiens
ggcacaaggcgccagcggcgag

SEQ ID NO: 563885 - DNA, 22 bp, Homo sapiens
aagtgtttataggcaggggccc

SEQ ID NO: 563886 - DNA, 22 bp, Homo sapiens
attttgatgatcaagcacgtat

SEQ ID NO: 563887 - DNA, 22 bp, Homo sapiens
tataaagtaaaatgagactgat

SEQ ID NO: 563888 - DNA, 22 bp, Homo sapiens
tgacctgtgaggggttgacagc

SEQ ID NO: 563889 - DNA, 22 bp, Homo sapiens
gcttcggagccctattttctcc

SEQ ID NO: 563890 - DNA, 22 bp, Homo sapiens
tagaccgagcagcccaactgaa

SEQ ID NO: 563891 - DNA, 22 bp, Homo sapiens
tgacatactgtgcctttttgat

SEQ ID NO: 563892 - DNA, 22 bp, Homo sapiens
tcctctacaaatgtcaccagca

SEQ ID NO: 563893 - DNA, 22 bp, Homo sapiens
tcaaagatggaaaagaaatgag

SEQ ID NO: 563894 - DNA, 22 bp, Homo sapiens
tgctccggaaggaccacataag

SEQ ID NO: 563895 - DNA, 22 bp, Homo sapiens
gaggtgagaagagaaagggctt

SEQ ID NO: 563896 - DNA, 22 bp, Homo sapiens
ccatctgttcactgtgtcctcc

SEQ ID NO: 563897 - DNA, 22 bp, Homo sapiens
aagggttaaagtgtatgggctt

SEQ ID NO: 563898 - DNA, 22 bp, Homo sapiens
ggactggcagcagaggacagaa

SEQ ID NO: 563899 - DNA, 22 bp, Homo sapiens
ctgacatggtgacagatctgtt

SEQ ID NO: 563900 - DNA, 22 bp, Homo sapiens
ttggttagacatactgaagata

SEQ ID NO: 563901 - DNA, 22 bp, Homo sapiens
cgtttacatgggtactggccat

SEQ ID NO: 563902 - DNA, 22 bp, Homo sapiens
tctggtttagtggatgctgatg

SEQ ID NO: 563903 - DNA, 22 bp, Homo sapiens
tgctggagaggccagttacggg

SEQ ID NO: 563904 - DNA, 22 bp, Homo sapiens
tggccctggggcaggagggtac

SEQ ID NO: 563905 - DNA, 22 bp, Homo sapiens
tactctgatcttactgcttatt

SEQ ID NO: 563906 - DNA, 22 bp, Homo sapiens
tttccaggtaccagagtcttgg

SEQ ID NO: 563907 - DNA, 22 bp, Homo sapiens
ggagctgatgattctttgatct

SEQ ID NO: 563908 - DNA, 22 bp, Homo sapiens
tggtttacagagtaaaccaata

SEQ ID NO: 563909 - DNA, 22 bp, Homo sapiens
ccaggcactgttatggatgatg

SEQ ID NO: 563910 - DNA, 22 bp, Homo sapiens
tgtgttcaggttcagaggtctg

SEQ ID NO: 563911 - DNA, 22 bp, Homo sapiens
gggccatgggcctcgtgtggcc

SEQ ID NO: 563912 - DNA, 22 bp, Homo sapiens
gacaacaccaaagggggtgggt

SEQ ID NO: 563913 - DNA, 22 bp, Homo sapiens
cgtctgcccaggctccacatgt

SEQ ID NO: 563914 - DNA, 22 bp, Homo sapiens
ttgataaatatgtaagtttttc

SEQ ID NO: 563915 - DNA, 22 bp, Homo sapiens
tttctcatttcataatgagatg

SEQ ID NO: 563916 - DNA, 22 bp, Homo sapiens
ggtcttgcctttgattgttgat

SEQ ID NO: 563917 - DNA, 22 bp, Homo sapiens
ggaagtggccttcaatagtccg

SEQ ID NO: 563918 - DNA, 22 bp, Homo sapiens
ggtgtgtgtgggtggggagggt

SEQ ID NO: 563919 - DNA, 22 bp, Homo sapiens
ttttggagttggaacgtccagg

SEQ ID NO: 563920 - DNA, 22 bp, Homo sapiens
tttaggtggttgcacaggcagg

SEQ ID NO: 563921 - DNA, 22 bp, Homo sapiens
tctccttggacaggtgcccttg

SEQ ID NO: 563922 - DNA, 22 bp, Homo sapiens
ccctgagcacatttgaaacatt

SEQ ID NO: 563923 - DNA, 22 bp, Homo sapiens
tcaaaatgtggtcaagtattgt

SEQ ID NO: 563924 - DNA, 22 bp, Homo sapiens
gcatgtggtgaccccactcatg

SEQ ID NO: 563925 - DNA, 22 bp, Homo sapiens
tcgcctggggtgaagtcatcct

SEQ ID NO: 563926 - DNA, 22 bp, Homo sapiens
ccagggagtcaaaggagaaggg

SEQ ID NO: 563927 - DNA, 22 bp, Homo sapiens
ttggacacatgtcctcctcctg

SEQ ID NO: 563928 - DNA, 22 bp, Homo sapiens
tttgtggatacaaatatttcct

SEQ ID NO: 563929 - DNA, 22 bp, Homo sapiens
aggggtggcagagtggtaagag

SEQ ID NO: 563930 - DNA, 22 bp, Homo sapiens
tattgtcttgtctggatccaga

SEQ ID NO: 563931 - DNA, 22 bp, Homo sapiens
ttgcaagagaaggtttctctgt

SEQ ID NO: 563932 - DNA, 22 bp, Homo sapiens
taagcttataacatgtatagac

SEQ ID NO: 563933 - DNA, 22 bp, Homo sapiens
tctgtggatatgttctctcttc

SEQ ID NO: 563934 - DNA, 22 bp, Homo sapiens
tagcctttgttctgcctctcac

SEQ ID NO: 563935 - DNA, 22 bp, Homo sapiens
gcccccgggaagggttgttgtc

SEQ ID NO: 563936 - DNA, 22 bp, Homo sapiens
tggatggggtggaggatgcaga

SEQ ID NO: 563937 - DNA, 22 bp, Homo sapiens
taaagcacagatcacatgtgtg

SEQ ID NO: 563938 - DNA, 22 bp, Homo sapiens
cctagctctagcaaggctggcc

SEQ ID NO: 563939 - DNA, 22 bp, Homo sapiens
aatgagttggggggttttagtg

SEQ ID NO: 563940 - DNA, 22 bp, Homo sapiens
gagctggaggcctggtgctgtt

SEQ ID NO: 563941 - DNA, 22 bp, Homo sapiens
tatttttttaaacattaatatt

SEQ ID NO: 563942 - DNA, 22 bp, Homo sapiens
cagttgattggaagaggaagga

SEQ ID NO: 563943 - DNA, 22 bp, Homo sapiens
cttggcagagagacactcccct

SEQ ID NO: 563944 - DNA, 22 bp, Homo sapiens
catttatggggcttggattggg

SEQ ID NO: 563945 - DNA, 22 bp, Homo sapiens
tgtttggaatgcagaacacatt

SEQ ID NO: 563946 - DNA, 22 bp, Homo sapiens
gagggaaagatgggaaggggac

SEQ ID NO: 563947 - DNA, 22 bp, Homo sapiens
gacccggaggcacccgcttccc

SEQ ID NO: 563948 - DNA, 22 bp, Homo sapiens
ggactctagacccaggaaggcc

SEQ ID NO: 563949 - DNA, 22 bp, Homo sapiens
cccaggcctcgcttccccagcc

SEQ ID NO: 563950 - DNA, 22 bp, Homo sapiens
atattacaatgagctcatcttt

SEQ ID NO: 563951 - DNA, 22 bp, Homo sapiens
tgcaagtgtgctgaactgtact

SEQ ID NO: 563952 - DNA, 22 bp, Homo sapiens
aggggggcctgcatctctgccc

SEQ ID NO: 563953 - DNA, 22 bp, Homo sapiens
tctgtgcaggttaacatttctg

SEQ ID NO: 563954 - DNA, 22 bp, Homo sapiens
atgggatctgggggtgaggggc

SEQ ID NO: 563955 - DNA, 22 bp, Homo sapiens
tctcaccgttacccggggcaac

SEQ ID NO: 563956 - DNA, 22 bp, Homo sapiens
atttttattgagtcttgattga

SEQ ID NO: 563957 - DNA, 22 bp, Homo sapiens
gggtaagtgtctacaggcaaaa

SEQ ID NO: 563958 - DNA, 22 bp, Homo sapiens
tgtctgcagcacatagattaga

SEQ ID NO: 563959 - DNA, 22 bp, Homo sapiens
gagctggccaggtccttccaac

SEQ ID NO: 563960 - DNA, 22 bp, Homo sapiens
tgctgctttataatgattataa

SEQ ID NO: 563961 - DNA, 22 bp, Homo sapiens
tggttgcatctgttttgatgtt

SEQ ID NO: 563962 - DNA, 22 bp, Homo sapiens
gggcagagagcaagaagtatca

SEQ ID NO: 563963 - DNA, 22 bp, Homo sapiens
ctatttctgggcctcctggcag

SEQ ID NO: 563964 - DNA, 22 bp, Homo sapiens
tcccttctaagtgttaccatca

SEQ ID NO: 563965 - DNA, 22 bp, Homo sapiens
atcttggccagcagggggcggt

SEQ ID NO: 563966 - DNA, 22 bp, Homo sapiens
tggcatgtgagtgaggaggtta

SEQ ID NO: 563967 - DNA, 22 bp, Homo sapiens
agttaaatttagatacctcgga

SEQ ID NO: 563968 - DNA, 22 bp, Homo sapiens
gatttgtgcttggctctgtcac

SEQ ID NO: 563969 - DNA, 22 bp, Homo sapiens
accctctatggtctccctcatg

SEQ ID NO: 563970 - DNA, 22 bp, Homo sapiens
tattcaagatgcgggagtcttt

SEQ ID NO: 563971 - DNA, 22 bp, Homo sapiens
agggtggacataaattgtctgt

SEQ ID NO: 563972 - DNA, 22 bp, Homo sapiens
tcactgagctaatatgttaaag

SEQ ID NO: 563973 - DNA, 22 bp, Homo sapiens
tggaagctcaaatcccaattct

SEQ ID NO: 563974 - DNA, 22 bp, Homo sapiens
tgtgcagcaactcagctggctt

SEQ ID NO: 563975 - DNA, 22 bp, Homo sapiens
aatcagtgatcctataaagtga

SEQ ID NO: 563976 - DNA, 22 bp, Homo sapiens
tctcctaccactagttgtgtcc

SEQ ID NO: 563977 - DNA, 22 bp, Homo sapiens
acatcctgcccttcagctttgg

SEQ ID NO: 563978 - DNA, 22 bp, Homo sapiens
gctgctgactctgattgccatt

SEQ ID NO: 563979 - DNA, 22 bp, Homo sapiens
tgatggacttgggaacttttgt

SEQ ID NO: 563980 - DNA, 22 bp, Homo sapiens
ttctaggcagagggacagcgga

SEQ ID NO: 563981 - DNA, 22 bp, Homo sapiens
tgaactcatgcgtttgagttga

SEQ ID NO: 563982 - DNA, 22 bp, Homo sapiens
agactctatattctgtctgtat

SEQ ID NO: 563983 - DNA, 22 bp, Homo sapiens
taagtgagatgagagggactga

SEQ ID NO: 563984 - DNA, 22 bp, Homo sapiens
taggagctaggagctgcggatc

SEQ ID NO: 563985 - DNA, 22 bp, Homo sapiens
ataggatcaggggtttggggtg

SEQ ID NO: 563986 - DNA, 22 bp, Homo sapiens
gggacagggcaggggaggtggg

SEQ ID NO: 563987 - DNA, 22 bp, Homo sapiens
caagcggtgctgttctcattgt

SEQ ID NO: 563988 - DNA, 22 bp, Homo sapiens
atatgtctggagttactgagct

SEQ ID NO: 563989 - DNA, 22 bp, Homo sapiens
tagatgccatgggaatattgtg

SEQ ID NO: 563990 - DNA, 22 bp, Homo sapiens
tggttcttgtgaaactggaagt

SEQ ID NO: 563991 - DNA, 22 bp, Homo sapiens
gtggtggtgtcctgtcagaatg

SEQ ID NO: 563992 - DNA, 22 bp, Homo sapiens
tatgcagatgtgaaacagataa

SEQ ID NO: 563993 - DNA, 22 bp, Homo sapiens
gtttgtatcttcaaagtgaaag

SEQ ID NO: 563994 - DNA, 22 bp, Homo sapiens
cctctctgggcctcagtttcct

SEQ ID NO: 563995 - DNA, 22 bp, Homo sapiens
tggccagaggtgagagctgccc

SEQ ID NO: 563996 - DNA, 22 bp, Homo sapiens
tggatctcttgggtatcggggt

SEQ ID NO: 563997 - DNA, 22 bp, Homo sapiens
tttgcagagctgaggaactgtt

SEQ ID NO: 563998 - DNA, 22 bp, Homo sapiens
gacactctttgctgtgggtttt

SEQ ID NO: 563999 - DNA, 22 bp, Homo sapiens
tagctcacgccccctctcccgg

SEQ ID NO: 564000 - DNA, 22 bp, Homo sapiens
tggtggctgctcaagggaggag

SEQ ID NO: 564001 - DNA, 22 bp, Homo sapiens
gagctttgtgtcatggtcatat

SEQ ID NO: 564002 - DNA, 22 bp, Homo sapiens
gcaattccttttttgaagctgg

SEQ ID NO: 564003 - DNA, 22 bp, Homo sapiens
agggatgtgggaggatgaagtg

SEQ ID NO: 564004 - DNA, 22 bp, Homo sapiens
gatggaaagcttgaggtcaacc

SEQ ID NO: 564005 - DNA, 22 bp, Homo sapiens
ttccctccccttccctcagctg

SEQ ID NO: 564006 - DNA, 22 bp, Homo sapiens
tgcccacacccaggggagctgc

SEQ ID NO: 564007 - DNA, 22 bp, Homo sapiens
tgggtctgtctcaggccagtct

SEQ ID NO: 564008 - DNA, 22 bp, Homo sapiens
aagctaaggtgcctgtgtttat

SEQ ID NO: 564009 - DNA, 22 bp, Homo sapiens
tagggatcagtggcatggggac

SEQ ID NO: 564010 - DNA, 22 bp, Homo sapiens
gtgagctggtctggggctgctg

SEQ ID NO: 564011 - DNA, 22 bp, Homo sapiens
cagctgcggatgggcatcaggc

SEQ ID NO: 564012 - DNA, 22 bp, Homo sapiens
tattgcattaatagatcatcag

SEQ ID NO: 564013 - DNA, 22 bp, Homo sapiens
tagctacgttttttcctcagca

SEQ ID NO: 564014 - DNA, 22 bp, Homo sapiens
agggtgaggtggggaggcggcg

SEQ ID NO: 564015 - DNA, 22 bp, Homo sapiens
aatgttacaactggtaaagtag

SEQ ID NO: 564016 - DNA, 22 bp, Homo sapiens
tgaggtcttccgatttgcagct

SEQ ID NO: 564017 - DNA, 22 bp, Homo sapiens
cagcccttttgtcaagtcatca

SEQ ID NO: 564018 - DNA, 22 bp, Homo sapiens
acctcctcccctctgatttgaa

SEQ ID NO: 564019 - DNA, 22 bp, Homo sapiens
tcttgtccttccttgttggggc

SEQ ID NO: 564020 - DNA, 22 bp, Homo sapiens
tctatcggcccccatcacttgt

SEQ ID NO: 564021 - DNA, 22 bp, Homo sapiens
taggggacctcctatagggata

SEQ ID NO: 564022 - DNA, 22 bp, Homo sapiens
tgccctgttcatacctgcctag

SEQ ID NO: 564023 - DNA, 22 bp, Homo sapiens
tgtctatgagagtgggctttgc

SEQ ID NO: 564024 - DNA, 22 bp, Homo sapiens
ttttaaatttttcttgctctgt

SEQ ID NO: 564025 - DNA, 22 bp, Homo sapiens
caccagccccccaggaaactcc

SEQ ID NO: 564026 - DNA, 22 bp, Homo sapiens
ggagactcacagaaggcccaag

SEQ ID NO: 564027 - DNA, 22 bp, Homo sapiens
tttagtgttcctttttcctgat

SEQ ID NO: 564028 - DNA, 22 bp, Homo sapiens
tgtggccctggtttccaggaca

SEQ ID NO: 564029 - DNA, 22 bp, Homo sapiens
ggtgaactgttactcccatcag

SEQ ID NO: 564030 - DNA, 22 bp, Homo sapiens
agcagccatggagcttggatct

SEQ ID NO: 564031 - DNA, 22 bp, Homo sapiens
tctgaaggcatgatttcaacag

SEQ ID NO: 564032 - DNA, 22 bp, Homo sapiens
tccaaggggatgctatggggaa

SEQ ID NO: 564033 - DNA, 22 bp, Homo sapiens
tagacaatctgtgtagagtgct

SEQ ID NO: 564034 - DNA, 22 bp, Homo sapiens
ctgagaattaagctgtcctttc

SEQ ID NO: 564035 - DNA, 22 bp, Homo sapiens
ttctttcaagaagctggaagtc

SEQ ID NO: 564036 - DNA, 22 bp, Homo sapiens
tggagggtgtgaattgaagatt

SEQ ID NO: 564037 - DNA, 22 bp, Homo sapiens
cacaacagagttggagagaaag

SEQ ID NO: 564038 - DNA, 22 bp, Homo sapiens
cccaaagttcagggaggccggg

SEQ ID NO: 564039 - DNA, 22 bp, Homo sapiens
tccttgatttctccttagagct

SEQ ID NO: 564040 - DNA, 22 bp, Homo sapiens
tggggaggtggtgtggctgtcg

SEQ ID NO: 564041 - DNA, 22 bp, Homo sapiens
caaagaggagtgggagaagaaa

SEQ ID NO: 564042 - DNA, 22 bp, Homo sapiens
cttcagcaagtcgcatcccctc

SEQ ID NO: 564043 - DNA, 22 bp, Homo sapiens
caataatgtttgtgcagtgcta

SEQ ID NO: 564044 - DNA, 22 bp, Homo sapiens
atgctgcataactcccctgagt

SEQ ID NO: 564045 - DNA, 22 bp, Homo sapiens
tgcagggtataggcgcgcccgc

SEQ ID NO: 564046 - DNA, 22 bp, Homo sapiens
gggggctgccccccgcccccca

SEQ ID NO: 564047 - DNA, 22 bp, Homo sapiens
catcacctttcctggccctgtc

SEQ ID NO: 564048 - DNA, 22 bp, Homo sapiens
tcagtgagtctgggggcgtgtg

SEQ ID NO: 564049 - DNA, 22 bp, Homo sapiens
caccagagactgatgaggccac

SEQ ID NO: 564050 - DNA, 22 bp, Homo sapiens
tgcgtgcacgtgggtgtctcct

SEQ ID NO: 564051 - DNA, 22 bp, Homo sapiens
caagatttatctcattctctga

SEQ ID NO: 564052 - DNA, 22 bp, Homo sapiens
tggggaatgcaatctactcatt

SEQ ID NO: 564053 - DNA, 22 bp, Homo sapiens
agattggaggggtctgatttgt

SEQ ID NO: 564054 - DNA, 22 bp, Homo sapiens
gaccagcacaggcccctctctc

SEQ ID NO: 564055 - DNA, 22 bp, Homo sapiens
ttttcactcagagctgtgcttg

SEQ ID NO: 564056 - DNA, 22 bp, Homo sapiens
tttgctttggtcgttcatgagt

SEQ ID NO: 564057 - DNA, 22 bp, Homo sapiens
tgccttgttacagctgcctctt

SEQ ID NO: 564058 - DNA, 22 bp, Homo sapiens
tctaagaagcttgccctgattc

SEQ ID NO: 564059 - DNA, 22 bp, Homo sapiens
gggcagggcggggtcctgtgct

SEQ ID NO: 564060 - DNA, 22 bp, Homo sapiens
cgggaggtaaggagcaaggcat

SEQ ID NO: 564061 - DNA, 22 bp, Homo sapiens
acattttcatatgacggtatag

SEQ ID NO: 564062 - DNA, 22 bp, Homo sapiens
agcatgctggaggcttgctagt

SEQ ID NO: 564063 - DNA, 22 bp, Homo sapiens
cttggtgagcaggacatgggtg

SEQ ID NO: 564064 - DNA, 22 bp, Homo sapiens
atcacccaggtgacagcgagca

SEQ ID NO: 564065 - DNA, 22 bp, Homo sapiens
ggtttgagtttctagttactag

SEQ ID NO: 564066 - DNA, 22 bp, Homo sapiens
cctcagccatgtggaggctgca

SEQ ID NO: 564067 - DNA, 22 bp, Homo sapiens
ggaccctggaggggttttcagt

SEQ ID NO: 564068 - DNA, 22 bp, Homo sapiens
ttagagtttggttatataccta

SEQ ID NO: 564069 - DNA, 22 bp, Homo sapiens
tttaattctacaagcatttatt

SEQ ID NO: 564070 - DNA, 22 bp, Homo sapiens
tttagccttaccttcaggttgc

SEQ ID NO: 564071 - DNA, 22 bp, Homo sapiens
tagtcatacccaccccagacct

SEQ ID NO: 564072 - DNA, 22 bp, Homo sapiens
ggatggcccatgtttcaccagc

SEQ ID NO: 564073 - DNA, 22 bp, Homo sapiens
gcccgccccctgcgcctccccg

SEQ ID NO: 564074 - DNA, 22 bp, Homo sapiens
ggaagcatcctgaggtgtccat

SEQ ID NO: 564075 - DNA, 22 bp, Homo sapiens
gcatactcatgaagcatcctag

SEQ ID NO: 564076 - DNA, 22 bp, Homo sapiens
tctgtaagaagaggctgcactg

SEQ ID NO: 564077 - DNA, 22 bp, Homo sapiens
accaacctgcctgttttagggg

SEQ ID NO: 564078 - DNA, 22 bp, Homo sapiens
taggaagtcttccttggttgca

SEQ ID NO: 564079 - DNA, 22 bp, Homo sapiens
ttctttccacattttgtgtctc

SEQ ID NO: 564080 - DNA, 22 bp, Homo sapiens
tggcaagcactgtagggatgca

SEQ ID NO: 564081 - DNA, 22 bp, Homo sapiens
tcctggtggacggagactggcc

SEQ ID NO: 564082 - DNA, 22 bp, Homo sapiens
ttcgaagttttaaaatttggag

SEQ ID NO: 564083 - DNA, 22 bp, Homo sapiens
ttcccaggctccagggagcctg

SEQ ID NO: 564084 - DNA, 22 bp, Homo sapiens
ttcaggggatcagagactaggc

SEQ ID NO: 564085 - DNA, 22 bp, Homo sapiens
tgatggggctgcatggttagcg

SEQ ID NO: 564086 - DNA, 22 bp, Homo sapiens
cccgtcgcccccgcagtcacgc

SEQ ID NO: 564087 - DNA, 22 bp, Homo sapiens
tggagcccaggcagctgggagc

SEQ ID NO: 564088 - DNA, 22 bp, Homo sapiens
ctgggagggctgttgggggagg

SEQ ID NO: 564089 - DNA, 22 bp, Homo sapiens
gagggcctctgggagggagccg

SEQ ID NO: 564090 - DNA, 22 bp, Homo sapiens
tggttgcatatgtaggatgtcc

SEQ ID NO: 564091 - DNA, 22 bp, Homo sapiens
tgagctatgcagatgctttgat

SEQ ID NO: 564092 - DNA, 22 bp, Homo sapiens
taatggcctaataatgcattag

SEQ ID NO: 564093 - DNA, 22 bp, Homo sapiens
cctgcagctgcactatagatgc

SEQ ID NO: 564094 - DNA, 22 bp, Homo sapiens
aacttatggggtttagctttta

SEQ ID NO: 564095 - DNA, 22 bp, Homo sapiens
ttgtacatggtaggctttcatt

SEQ ID NO: 564096 - DNA, 22 bp, Homo sapiens
gtgtagacaatgtgcacggacc

SEQ ID NO: 564097 - DNA, 22 bp, Homo sapiens
tgagtctgtgtgtgggtttcta

SEQ ID NO: 564098 - DNA, 22 bp, Homo sapiens
aggcctcaggacagaagccgag

SEQ ID NO: 564099 - DNA, 22 bp, Homo sapiens
tctccttcaggagtgggctttg

SEQ ID NO: 564100 - DNA, 22 bp, Homo sapiens
atgttgggaaggacaaagggtg

SEQ ID NO: 564101 - DNA, 22 bp, Homo sapiens
tcagcttgtccatggactgtgt

SEQ ID NO: 564102 - DNA, 22 bp, Homo sapiens
ttcctgctccactgccggggct

SEQ ID NO: 564103 - DNA, 22 bp, Homo sapiens
tagagaatagggaagagctgtg

SEQ ID NO: 564104 - DNA, 22 bp, Homo sapiens
caccctcccactgtggtttctt

SEQ ID NO: 564105 - DNA, 22 bp, Homo sapiens
tgctaggaagtgccaggttgat

SEQ ID NO: 564106 - DNA, 22 bp, Homo sapiens
ttagctgaaggtcctggttgtc

SEQ ID NO: 564107 - DNA, 22 bp, Homo sapiens
gggctggggaggctggagggga

SEQ ID NO: 564108 - DNA, 22 bp, Homo sapiens
gcatttctcattagcaacagac

SEQ ID NO: 564109 - DNA, 22 bp, Homo sapiens
ttgatgctggggaactctgtgg

SEQ ID NO: 564110 - DNA, 22 bp, Homo sapiens
tatatgaaatatcttaagttta

SEQ ID NO: 564111 - DNA, 22 bp, Homo sapiens
ctaatccattacagaggggagg

SEQ ID NO: 564112 - DNA, 22 bp, Homo sapiens
tcagcgtttcacactgcctggt

SEQ ID NO: 564113 - DNA, 22 bp, Homo sapiens
cctgcagctgctgccgcctcct

SEQ ID NO: 564114 - DNA, 22 bp, Homo sapiens
tgacagaacaatgtggagagag

SEQ ID NO: 564115 - DNA, 22 bp, Homo sapiens
atctgtagctgtctgtggaggg

SEQ ID NO: 564116 - DNA, 22 bp, Homo sapiens
agtctgttccggaggggtacca

SEQ ID NO: 564117 - DNA, 22 bp, Homo sapiens
tcaagaactttgatcagggagt

SEQ ID NO: 564118 - DNA, 22 bp, Homo sapiens
cctctaagagttcttttctcct

SEQ ID NO: 564119 - DNA, 22 bp, Homo sapiens
tacactgtctaggtctgctttg

SEQ ID NO: 564120 - DNA, 22 bp, Homo sapiens
tgttcagaggtgagagtgagcc

SEQ ID NO: 564121 - DNA, 22 bp, Homo sapiens
ttataatttatgagctgactac

SEQ ID NO: 564122 - DNA, 22 bp, Homo sapiens
ccctgggggacggccgctctgt

SEQ ID NO: 564123 - DNA, 22 bp, Homo sapiens
tgaaggtcaaagcttgcttaat

SEQ ID NO: 564124 - DNA, 22 bp, Homo sapiens
tggacagagggggaaatccaga

SEQ ID NO: 564125 - DNA, 22 bp, Homo sapiens
tggacctggaggtgaattcagc

SEQ ID NO: 564126 - DNA, 22 bp, Homo sapiens
ttcccagcgccagccctcccca

SEQ ID NO: 564127 - DNA, 22 bp, Homo sapiens
gtggtgggagagcggtgggggt

SEQ ID NO: 564128 - DNA, 22 bp, Homo sapiens
tttggggtaagggtctagggtt

SEQ ID NO: 564129 - DNA, 22 bp, Homo sapiens
ttcattcaactaacaaatattt

SEQ ID NO: 564130 - DNA, 22 bp, Homo sapiens
ttggctgcaggggagtagtggc

SEQ ID NO: 564131 - DNA, 22 bp, Homo sapiens
ttccaggagtgacgctaaggct

SEQ ID NO: 564132 - DNA, 22 bp, Homo sapiens
gtcagggactagctagagactg

SEQ ID NO: 564133 - DNA, 22 bp, Homo sapiens
tcatgtgataggaagttactaa

SEQ ID NO: 564134 - DNA, 22 bp, Homo sapiens
tgaacagcacagtggcttacgt

SEQ ID NO: 564135 - DNA, 22 bp, Homo sapiens
tccccagggccagttgagaggc

SEQ ID NO: 564136 - DNA, 22 bp, Homo sapiens
gtactttagaagtaccatttgc

SEQ ID NO: 564137 - DNA, 22 bp, Homo sapiens
ttcttcattgttgctctgcctc

SEQ ID NO: 564138 - DNA, 22 bp, Homo sapiens
aaagcgcttcccttttgagggt

SEQ ID NO: 564139 - DNA, 22 bp, Homo sapiens
caaaatgtgccaggatgtcttg

SEQ ID NO: 564140 - DNA, 22 bp, Homo sapiens
tactgaatcagtgaatggtttt

SEQ ID NO: 564141 - DNA, 22 bp, Homo sapiens
aacttgctcaaggtttcatgta

SEQ ID NO: 564142 - DNA, 22 bp, Homo sapiens
tgcgtgcgcacacgggcctgca

SEQ ID NO: 564143 - DNA, 22 bp, Homo sapiens
cgtccacccagactgtgcagcc

SEQ ID NO: 564144 - DNA, 22 bp, Homo sapiens
tagagagcctggtgttcacgcc

SEQ ID NO: 564145 - DNA, 22 bp, Homo sapiens
taggggctcccttgggtccttc

SEQ ID NO: 564146 - DNA, 22 bp, Homo sapiens
gctggcaggagctgcctcttca

SEQ ID NO: 564147 - DNA, 22 bp, Homo sapiens
ggtgagggggtgggaggtgtgg

SEQ ID NO: 564148 - DNA, 22 bp, Homo sapiens
aattagttcgcttggagtcacc

SEQ ID NO: 564149 - DNA, 22 bp, Homo sapiens
aggagtcttcatcagctagata

SEQ ID NO: 564150 - DNA, 22 bp, Homo sapiens
tgcagtttaaggcacaattagc

SEQ ID NO: 564151 - DNA, 22 bp, Homo sapiens
tgggaaggtagggaggagagac

SEQ ID NO: 564152 - DNA, 22 bp, Homo sapiens
agacgtgaaggcagcggggctc

SEQ ID NO: 564153 - DNA, 22 bp, Homo sapiens
tttgtgggttaatgaatgagtc

SEQ ID NO: 564154 - DNA, 22 bp, Homo sapiens
actcaggtttaatacttggctt

SEQ ID NO: 564155 - DNA, 22 bp, Homo sapiens
gagatcaatatcaagatttgtt

SEQ ID NO: 564156 - DNA, 22 bp, Homo sapiens
ttgtttgcctcaacttcttttg

SEQ ID NO: 564157 - DNA, 22 bp, Homo sapiens
taacagggtggaaacttgataa

SEQ ID NO: 564158 - DNA, 22 bp, Homo sapiens
ttctgccccctccccacctcag

SEQ ID NO: 564159 - DNA, 22 bp, Homo sapiens
tgtattgaaaatgctgctgggg

SEQ ID NO: 564160 - DNA, 22 bp, Homo sapiens
gagcggggatggcgagcagctg

SEQ ID NO: 564161 - DNA, 22 bp, Homo sapiens
tgtgtcaatatgcgatgatgtg

SEQ ID NO: 564162 - DNA, 22 bp, Homo sapiens
ttactatcgggcattagatgct

SEQ ID NO: 564163 - DNA, 22 bp, Homo sapiens
tcatggtcccagcagccaggcc

SEQ ID NO: 564164 - DNA, 22 bp, Homo sapiens
ccccttgatgaacaaggctaac

SEQ ID NO: 564165 - DNA, 22 bp, Homo sapiens
ttcttcttgagtaacatcagat

SEQ ID NO: 564166 - DNA, 22 bp, Homo sapiens
gactttaataaaagggaaatga

SEQ ID NO: 564167 - DNA, 22 bp, Homo sapiens
gggggtgcagaagtttggagca

SEQ ID NO: 564168 - DNA, 22 bp, Homo sapiens
tgtttgacactttcacttttcc

SEQ ID NO: 564169 - DNA, 22 bp, Homo sapiens
gagagagatcttttctgtgttt

SEQ ID NO: 564170 - DNA, 22 bp, Homo sapiens
tcagtggggccagggccatgtt

SEQ ID NO: 564171 - DNA, 22 bp, Homo sapiens
gggtttaatttgtatcccaatg

SEQ ID NO: 564172 - DNA, 22 bp, Homo sapiens
tttccagagtcatctgtgaggg

SEQ ID NO: 564173 - DNA, 22 bp, Homo sapiens
gcctttctttgtgaagacggaa

SEQ ID NO: 564174 - DNA, 22 bp, Homo sapiens
tgaatcacgcttgcaaactgtc

SEQ ID NO: 564175 - DNA, 22 bp, Homo sapiens
tcaaggatgattctgaaagagc

SEQ ID NO: 564176 - DNA, 22 bp, Homo sapiens
tttggtagtaggtagggtagta

SEQ ID NO: 564177 - DNA, 22 bp, Homo sapiens
tctctgtcattctaggcaagaa

SEQ ID NO: 564178 - DNA, 22 bp, Homo sapiens
cagtgtctgcttggctccaggg

SEQ ID NO: 564179 - DNA, 22 bp, Homo sapiens
ggaatatctatattgtagggtt

SEQ ID NO: 564180 - DNA, 22 bp, Homo sapiens
cattggttctcttccttgtatt

SEQ ID NO: 564181 - DNA, 22 bp, Homo sapiens
gtaatttttccagtgtaccatt

SEQ ID NO: 564182 - DNA, 22 bp, Homo sapiens
gctggagatgagggctgcgcag

SEQ ID NO: 564183 - DNA, 22 bp, Homo sapiens
tgcgggagtttgcggtctccgg

SEQ ID NO: 564184 - DNA, 22 bp, Homo sapiens
tcagatcttaagcaacttgagg

SEQ ID NO: 564185 - DNA, 22 bp, Homo sapiens
ttaacctctctggacctctttg

SEQ ID NO: 564186 - DNA, 22 bp, Homo sapiens
gtcgatacatcttgattcagtg

SEQ ID NO: 564187 - DNA, 22 bp, Homo sapiens
tttcccttctcccttcaccatt

SEQ ID NO: 564188 - DNA, 22 bp, Homo sapiens
agttgctcctgtacttagctgc

SEQ ID NO: 564189 - DNA, 22 bp, Homo sapiens
tcagcttctttaatttggtgga

SEQ ID NO: 564190 - DNA, 22 bp, Homo sapiens
tgattgactttagtgatgtgcc

SEQ ID NO: 564191 - DNA, 22 bp, Homo sapiens
atggcgttcttatagaagaatg

SEQ ID NO: 564192 - DNA, 22 bp, Homo sapiens
tgtatgtgaaaatgtcaagtgc

SEQ ID NO: 564193 - DNA, 22 bp, Homo sapiens
tggttgtggccacttggatttc

SEQ ID NO: 564194 - DNA, 22 bp, Homo sapiens
tctaaattgtgaagaataagca

SEQ ID NO: 564195 - DNA, 22 bp, Homo sapiens
aaatgctagggagaaactctcc

SEQ ID NO: 564196 - DNA, 22 bp, Homo sapiens
gagcgggagggcccagggtgag

SEQ ID NO: 564197 - DNA, 22 bp, Homo sapiens
taaagggggagaggtggggggg

SEQ ID NO: 564198 - DNA, 22 bp, Homo sapiens
tacatatttgatgcaataaata

SEQ ID NO: 564199 - DNA, 22 bp, Homo sapiens
tctttcccacccatctttgttc

SEQ ID NO: 564200 - DNA, 22 bp, Homo sapiens
cgagggagtgggaggacgtcgg

SEQ ID NO: 564201 - DNA, 22 bp, Homo sapiens
tgggtggagggagggatcagga

SEQ ID NO: 564202 - DNA, 22 bp, Homo sapiens
gatttacctccagaagtatttt

SEQ ID NO: 564203 - DNA, 22 bp, Homo sapiens
ggatccttacggtgtaatgggg

SEQ ID NO: 564204 - DNA, 22 bp, Homo sapiens
tgagcgcggcggctgggtctcg

SEQ ID NO: 564205 - DNA, 22 bp, Homo sapiens
tttatggcaatttgcatcgtta

SEQ ID NO: 564206 - DNA, 22 bp, Homo sapiens
tgagagtactaggggtttccct

SEQ ID NO: 564207 - DNA, 22 bp, Homo sapiens
ctctggagggaggaaggcaaag

SEQ ID NO: 564208 - DNA, 22 bp, Homo sapiens
ttgcatccatgttaaagaggaa

SEQ ID NO: 564209 - DNA, 22 bp, Homo sapiens
tgggctggcccggcctttgctg

SEQ ID NO: 564210 - DNA, 22 bp, Homo sapiens
ttgcaaacaagctgtggccata

SEQ ID NO: 564211 - DNA, 22 bp, Homo sapiens
agcttgtaaatgtgtgtgtggt

SEQ ID NO: 564212 - DNA, 22 bp, Homo sapiens
ggcagttcctagaggagggggg

SEQ ID NO: 564213 - DNA, 22 bp, Homo sapiens
tcaaatcactggggtaccattt

SEQ ID NO: 564214 - DNA, 22 bp, Homo sapiens
caagtggaagttactttacctc

SEQ ID NO: 564215 - DNA, 22 bp, Homo sapiens
gctcattccccttctatctgca

SEQ ID NO: 564216 - DNA, 22 bp, Homo sapiens
taatcacgtgtcacatatgact

SEQ ID NO: 564217 - DNA, 22 bp, Homo sapiens
tcctttcccagtgctccttcct

SEQ ID NO: 564218 - DNA, 22 bp, Homo sapiens
tcattacctgccagctggcctc

SEQ ID NO: 564219 - DNA, 22 bp, Homo sapiens
taactaatagtatgtattagta

SEQ ID NO: 564220 - DNA, 22 bp, Homo sapiens
aattccgaatggccccagtccc

SEQ ID NO: 564221 - DNA, 22 bp, Homo sapiens
ctcagttaacaggaatcagtga

SEQ ID NO: 564222 - DNA, 22 bp, Homo sapiens
ccggctatttggcgggagcaga

SEQ ID NO: 564223 - DNA, 22 bp, Homo sapiens
aggaaggcaaaggagaggacag

SEQ ID NO: 564224 - DNA, 22 bp, Homo sapiens
ggagttgagggtgttcttgcag

SEQ ID NO: 564225 - DNA, 22 bp, Homo sapiens
tgacatagccaacctttaaaaa

SEQ ID NO: 564226 - DNA, 22 bp, Homo sapiens
gagttttctttccagggaatag

SEQ ID NO: 564227 - DNA, 22 bp, Homo sapiens
ggtaggtgagtgagggtggggt

SEQ ID NO: 564228 - DNA, 22 bp, Homo sapiens
tgggacatctgtgatttcagtc

SEQ ID NO: 564229 - DNA, 22 bp, Homo sapiens
tgtctccctccctctgtctgct

SEQ ID NO: 564230 - DNA, 22 bp, Homo sapiens
cacacgggcagcggaggaacca

SEQ ID NO: 564231 - DNA, 22 bp, Homo sapiens
tttcagtagtttagccctaagg

SEQ ID NO: 564232 - DNA, 22 bp, Homo sapiens
cccggatcattgccacgataga

SEQ ID NO: 564233 - DNA, 22 bp, Homo sapiens
gtagaatgaggcctgacatatc

SEQ ID NO: 564234 - DNA, 22 bp, Homo sapiens
atcccctgtgaaccttgacctg

SEQ ID NO: 564235 - DNA, 22 bp, Homo sapiens
ttcatcccccacatcccttttc

SEQ ID NO: 564236 - DNA, 22 bp, Homo sapiens
aaaatgggagggaatggtggtg

SEQ ID NO: 564237 - DNA, 22 bp, Homo sapiens
tatttggctatctaatgcaaga

SEQ ID NO: 564238 - DNA, 22 bp, Homo sapiens
gactaaactgtaggctcttctc

SEQ ID NO: 564239 - DNA, 22 bp, Homo sapiens
tgctccagtaaggtctccagga

SEQ ID NO: 564240 - DNA, 22 bp, Homo sapiens
gaccctgctgacctgcttagtt

SEQ ID NO: 564241 - DNA, 22 bp, Homo sapiens
agtccccagaaatgaaaatggg

SEQ ID NO: 564242 - DNA, 22 bp, Homo sapiens
catcttgagatgggaacttatc

SEQ ID NO: 564243 - DNA, 22 bp, Homo sapiens
ttaatgctcatttggctctgca

SEQ ID NO: 564244 - DNA, 22 bp, Homo sapiens
ttctcccaaactcttcctgctt

SEQ ID NO: 564245 - DNA, 22 bp, Homo sapiens
tcctctgtcctcaagtctgagc

SEQ ID NO: 564246 - DNA, 22 bp, Homo sapiens
aggcaaaacttggttgtcagta

SEQ ID NO: 564247 - DNA, 22 bp, Homo sapiens
cctaggtgtgctccggtggggg

SEQ ID NO: 564248 - DNA, 22 bp, Homo sapiens
taggtaaactaccaaatctcat

SEQ ID NO: 564249 - DNA, 22 bp, Homo sapiens
gagcaagtatctgtgatttggg

SEQ ID NO: 564250 - DNA, 22 bp, Homo sapiens
tccaaggagaaatgggcaacag

SEQ ID NO: 564251 - DNA, 22 bp, Homo sapiens
taccatggagtttggagtgaga

SEQ ID NO: 564252 - DNA, 22 bp, Homo sapiens
ttgctcatcccccagtgcctca

SEQ ID NO: 564253 - DNA, 22 bp, Homo sapiens
tctgtgacaaagggccacgcct

SEQ ID NO: 564254 - DNA, 22 bp, Homo sapiens
ggggttctttgtgctttgataa

SEQ ID NO: 564255 - DNA, 22 bp, Homo sapiens
gctctgcactttgattggacat

SEQ ID NO: 564256 - DNA, 22 bp, Homo sapiens
ccctccagacttctcttcccag

SEQ ID NO: 564257 - DNA, 22 bp, Homo sapiens
tattcattaaggggctttcatt

SEQ ID NO: 564258 - DNA, 22 bp, Homo sapiens
gaagagaggtttgggacagcaa

SEQ ID NO: 564259 - DNA, 22 bp, Homo sapiens
tctgtttgacagttctggctta

SEQ ID NO: 564260 - DNA, 22 bp, Homo sapiens
aggcaatgtcaggaaagaggaa

SEQ ID NO: 564261 - DNA, 22 bp, Homo sapiens
ttcctttccctgctccaaagtt

SEQ ID NO: 564262 - DNA, 22 bp, Homo sapiens
tcttctgtttttgttaggaggg

SEQ ID NO: 564263 - DNA, 22 bp, Homo sapiens
acccattggtgcctccctagac

SEQ ID NO: 564264 - DNA, 22 bp, Homo sapiens
tgcagatgctaaattaaagaga

SEQ ID NO: 564265 - DNA, 22 bp, Homo sapiens
tgtgatttccaacattgcaatg

SEQ ID NO: 564266 - DNA, 22 bp, Homo sapiens
gaggttgaattagatagattca

SEQ ID NO: 564267 - DNA, 22 bp, Homo sapiens
tgagtctcagatgtaaaggatt

SEQ ID NO: 564268 - DNA, 22 bp, Homo sapiens
ttacctcctcctcaatgaggct

SEQ ID NO: 564269 - DNA, 22 bp, Homo sapiens
tggcagtgtctaggggtctggg

SEQ ID NO: 564270 - DNA, 22 bp, Homo sapiens
gctcttggcttggagctcctgg

SEQ ID NO: 564271 - DNA, 22 bp, Homo sapiens
gctcctgccttgtggctgtctc

SEQ ID NO: 564272 - DNA, 22 bp, Homo sapiens
taactctgatccgctgtgagga

SEQ ID NO: 564273 - DNA, 22 bp, Homo sapiens
gactacaatatgtaatctaata

SEQ ID NO: 564274 - DNA, 22 bp, Homo sapiens
tgactaggacagaacctaggaa

SEQ ID NO: 564275 - DNA, 22 bp, Homo sapiens
gctattagctaatggtgggttc

SEQ ID NO: 564276 - DNA, 22 bp, Homo sapiens
tgcactcagctgccactgtccg

SEQ ID NO: 564277 - DNA, 22 bp, Homo sapiens
tacaggtcctagcatgcaatgg

SEQ ID NO: 564278 - DNA, 22 bp, Homo sapiens
acctcactcggctaaggatttt

SEQ ID NO: 564279 - DNA, 22 bp, Homo sapiens
aggaaggtatacagaattgtaa

SEQ ID NO: 564280 - DNA, 22 bp, Homo sapiens
tatgtggggtatgtttggtatc

SEQ ID NO: 564281 - DNA, 22 bp, Homo sapiens
tcctggtgcagtgttccgaaat

SEQ ID NO: 564282 - DNA, 22 bp, Homo sapiens
ttctggagggagatataaactc

SEQ ID NO: 564283 - DNA, 22 bp, Homo sapiens
tggggttaagtgaggagttcag

SEQ ID NO: 564284 - DNA, 22 bp, Homo sapiens
gcagttggctttcttctggtct

SEQ ID NO: 564285 - DNA, 22 bp, Homo sapiens
caggtgagcttcctcgtgtgga

SEQ ID NO: 564286 - DNA, 22 bp, Homo sapiens
aaatgtctgcatggctgtctgc

SEQ ID NO: 564287 - DNA, 22 bp, Homo sapiens
attacaccagcagcgagaggag

SEQ ID NO: 564288 - DNA, 22 bp, Homo sapiens
tttatgaagtggaaatgtggtc

SEQ ID NO: 564289 - DNA, 22 bp, Homo sapiens
tctgatggcttaggtaaacact

SEQ ID NO: 564290 - DNA, 22 bp, Homo sapiens
ctgcacaagttctggtgtcctg

SEQ ID NO: 564291 - DNA, 22 bp, Homo sapiens
tcatgtattcagttgtctttgg

SEQ ID NO: 564292 - DNA, 22 bp, Homo sapiens
gagtcaccatggcagtatagca

SEQ ID NO: 564293 - DNA, 22 bp, Homo sapiens
tgatgcttgggaccccagagct

SEQ ID NO: 564294 - DNA, 22 bp, Homo sapiens
tgcagcgagccttgctctatca

SEQ ID NO: 564295 - DNA, 22 bp, Homo sapiens
gttgctagttgcactcctctct

SEQ ID NO: 564296 - DNA, 22 bp, Homo sapiens
tccttgttccagagattctgac

SEQ ID NO: 564297 - DNA, 22 bp, Homo sapiens
tggggtctggagtggtgggggt

SEQ ID NO: 564298 - DNA, 22 bp, Homo sapiens
atctccccacctgctccctcag

SEQ ID NO: 564299 - DNA, 22 bp, Homo sapiens
tgggactctagggccagccctg

SEQ ID NO: 564300 - DNA, 22 bp, Homo sapiens
tgtttccagggtgacgtagatt

SEQ ID NO: 564301 - DNA, 22 bp, Homo sapiens
tgggagcttttgctttctactt

SEQ ID NO: 564302 - DNA, 22 bp, Homo sapiens
tagccatgtcataaaatggtta

SEQ ID NO: 564303 - DNA, 22 bp, Homo sapiens
cttctccaggaggatttacaaa

SEQ ID NO: 564304 - DNA, 22 bp, Homo sapiens
gagtagtcggctccctcctttc

SEQ ID NO: 564305 - DNA, 22 bp, Homo sapiens
gttccttgatagagagaaggga

SEQ ID NO: 564306 - DNA, 22 bp, Homo sapiens
taaatcacacctgcctttgaac

SEQ ID NO: 564307 - DNA, 22 bp, Homo sapiens
aattggctcaatatctccctgt

SEQ ID NO: 564308 - DNA, 22 bp, Homo sapiens
gtggccaggacagaggtggagg

SEQ ID NO: 564309 - DNA, 22 bp, Homo sapiens
tcctttgagctgggtcttcatg

SEQ ID NO: 564310 - DNA, 22 bp, Homo sapiens
tacttgagggtccggggaacag

SEQ ID NO: 564311 - DNA, 22 bp, Homo sapiens
ggaggggggaaacaaggggagc

SEQ ID NO: 564312 - DNA, 22 bp, Homo sapiens
cccgcgtgggggggacgggaag

SEQ ID NO: 564313 - DNA, 22 bp, Homo sapiens
gtcttcggcaatggaggagatg

SEQ ID NO: 564314 - DNA, 22 bp, Homo sapiens
gtgtaggtttcctgggttgtcc

SEQ ID NO: 564315 - DNA, 22 bp, Homo sapiens
acaaggcacgtgtgtcctgacc

SEQ ID NO: 564316 - DNA, 22 bp, Homo sapiens
agaccagttggagtggtggact

SEQ ID NO: 564317 - DNA, 22 bp, Homo sapiens
tcttctcttcctcctcatacca

SEQ ID NO: 564318 - DNA, 22 bp, Homo sapiens
tcacatattccaaaatttcttc

SEQ ID NO: 564319 - DNA, 22 bp, Homo sapiens
tcagcctgccgtccacactctc

SEQ ID NO: 564320 - DNA, 22 bp, Homo sapiens
aactcaacaaccttaggacagc

SEQ ID NO: 564321 - DNA, 22 bp, Homo sapiens
tcaccctcatggcctcccactt

SEQ ID NO: 564322 - DNA, 22 bp, Homo sapiens
agcaaagcagagccaaggcttc

SEQ ID NO: 564323 - DNA, 22 bp, Homo sapiens
tccaaagtgaagataaaactcc

SEQ ID NO: 564324 - DNA, 22 bp, Homo sapiens
ggtcaaagtaaacagattatac

SEQ ID NO: 564325 - DNA, 22 bp, Homo sapiens
tggtggggaggggggcaggtcc

SEQ ID NO: 564326 - DNA, 22 bp, Homo sapiens
tagggctacagcccccattgtc

SEQ ID NO: 564327 - DNA, 22 bp, Homo sapiens
agggaatagtcttaaaagaata

SEQ ID NO: 564328 - DNA, 22 bp, Homo sapiens
cccctgggcgctcacttcagct

SEQ ID NO: 564329 - DNA, 22 bp, Homo sapiens
aggaattaatggcccgctgagg

SEQ ID NO: 564330 - DNA, 22 bp, Homo sapiens
aaaggatttatatacttcccta

SEQ ID NO: 564331 - DNA, 22 bp, Homo sapiens
caccggccgctccatgtgaaac

SEQ ID NO: 564332 - DNA, 22 bp, Homo sapiens
tctccatttttttctgtgtgca

SEQ ID NO: 564333 - DNA, 22 bp, Homo sapiens
tggttttagtgcagaatctctg

SEQ ID NO: 564334 - DNA, 22 bp, Homo sapiens
tgcaggggtctgcaggtggcct

SEQ ID NO: 564335 - DNA, 22 bp, Homo sapiens
gctctggagtagtgataagaca

SEQ ID NO: 564336 - DNA, 22 bp, Homo sapiens
agagccctaggcagtgttgtcc

SEQ ID NO: 564337 - DNA, 22 bp, Homo sapiens
gagaggctggcctcaggagcta

SEQ ID NO: 564338 - DNA, 22 bp, Homo sapiens
tgttcagtgtcttggttggctg

SEQ ID NO: 564339 - DNA, 22 bp, Homo sapiens
tggcgaagggaaaggagggagt

SEQ ID NO: 564340 - DNA, 22 bp, Homo sapiens
tcctttctcctctgaaccactc

SEQ ID NO: 564341 - DNA, 22 bp, Homo sapiens
tatcttacatactgctgtctcc

SEQ ID NO: 564342 - DNA, 22 bp, Homo sapiens
agggtatgcggatatggataac

SEQ ID NO: 564343 - DNA, 22 bp, Homo sapiens
gcaggggccctgcttccgttta

SEQ ID NO: 564344 - DNA, 22 bp, Homo sapiens
aattcttcaactctgtgatgaa

SEQ ID NO: 564345 - DNA, 22 bp, Homo sapiens
ctgagggcggtgcctctcttct

SEQ ID NO: 564346 - DNA, 22 bp, Homo sapiens
tcgaatccctgcttcttcactg

SEQ ID NO: 564347 - DNA, 22 bp, Homo sapiens
accaggcccttttctcctggga

SEQ ID NO: 564348 - DNA, 22 bp, Homo sapiens
aataaggtcagatggggtgagg

SEQ ID NO: 564349 - DNA, 22 bp, Homo sapiens
taaactggcagagtgcaaacaa

SEQ ID NO: 564350 - DNA, 22 bp, Homo sapiens
taataagtttctccaaagcaca

SEQ ID NO: 564351 - DNA, 22 bp, Homo sapiens
ttttaaattgaatcttccagct

SEQ ID NO: 564352 - DNA, 22 bp, Homo sapiens
tctgcagctgttgctgtgcctg

SEQ ID NO: 564353 - DNA, 22 bp, Homo sapiens
tagcagggcaggctggcacccc

SEQ ID NO: 564354 - DNA, 22 bp, Homo sapiens
aggtatagaattgaaagcactc

SEQ ID NO: 564355 - DNA, 22 bp, Homo sapiens
tacctgagtgtagatattgacc

SEQ ID NO: 564356 - DNA, 22 bp, Homo sapiens
tgccgtccttgaattgatcagc

SEQ ID NO: 564357 - DNA, 22 bp, Homo sapiens
tcctcattgggccctggccagg

SEQ ID NO: 564358 - DNA, 22 bp, Homo sapiens
tcatcatctctggtactgcttt

SEQ ID NO: 564359 - DNA, 22 bp, Homo sapiens
gaccacatgggaggctcatggc

SEQ ID NO: 564360 - DNA, 22 bp, Homo sapiens
acgattgttctctccttgcgca

SEQ ID NO: 564361 - DNA, 22 bp, Homo sapiens
ggtggttgttaatttttggcgt

SEQ ID NO: 564362 - DNA, 22 bp, Homo sapiens
tagaacattttatcttcaccac

SEQ ID NO: 564363 - DNA, 22 bp, Homo sapiens
ttctaggcagaatgtagcagaa

SEQ ID NO: 564364 - DNA, 22 bp, Homo sapiens
tcagtcttgggtcgggttttct

SEQ ID NO: 564365 - DNA, 22 bp, Homo sapiens
tggctgataaacaatagtactt

SEQ ID NO: 564366 - DNA, 22 bp, Homo sapiens
tggctgttgtggtgtgcaaaac

SEQ ID NO: 564367 - DNA, 22 bp, Homo sapiens
atctgaatttctgttgttttcc

SEQ ID NO: 564368 - DNA, 22 bp, Homo sapiens
actcgagagagtagcaatcaca

SEQ ID NO: 564369 - DNA, 22 bp, Homo sapiens
ttttattatagacaatccactt

SEQ ID NO: 564370 - DNA, 22 bp, Homo sapiens
agaaagaggcacatttctagat

SEQ ID NO: 564371 - DNA, 22 bp, Homo sapiens
ccacatttccaaagatgccagt

SEQ ID NO: 564372 - DNA, 22 bp, Homo sapiens
gaatgaactgtggctacctgtg

SEQ ID NO: 564373 - DNA, 22 bp, Homo sapiens
tctcctgtcaccttgctctcct

SEQ ID NO: 564374 - DNA, 22 bp, Homo sapiens
caggctgctgtaagccttgcaa

SEQ ID NO: 564375 - DNA, 22 bp, Homo sapiens
cccccgggtaaagcagcccatg

SEQ ID NO: 564376 - DNA, 22 bp, Homo sapiens
agccagtctatacgccatctct

SEQ ID NO: 564377 - DNA, 22 bp, Homo sapiens
agtctattttcaaagtgagagg

SEQ ID NO: 564378 - DNA, 22 bp, Homo sapiens
tcatgaagcttacagtatgatc

SEQ ID NO: 564379 - DNA, 22 bp, Homo sapiens
gaggcctgtggaacacatggct

SEQ ID NO: 564380 - DNA, 22 bp, Homo sapiens
tcttggttttgatgactccctc

SEQ ID NO: 564381 - DNA, 22 bp, Homo sapiens
aaggtagaggtcaccggcacat

SEQ ID NO: 564382 - DNA, 22 bp, Homo sapiens
tccccagggggcaggtccatct

SEQ ID NO: 564383 - DNA, 22 bp, Homo sapiens
tgcaggctgagtgaccctgggc

SEQ ID NO: 564384 - DNA, 22 bp, Homo sapiens
ttaaaatgtttaccatttccag

SEQ ID NO: 564385 - DNA, 22 bp, Homo sapiens
tcagggcagaggccacagagga

SEQ ID NO: 564386 - DNA, 22 bp, Homo sapiens
tcccaatcttagagaacttcct

SEQ ID NO: 564387 - DNA, 22 bp, Homo sapiens
taaaatgtttcctaccattttt

SEQ ID NO: 564388 - DNA, 22 bp, Homo sapiens
tccgtcattattcaataatagc

SEQ ID NO: 564389 - DNA, 22 bp, Homo sapiens
tttgaatcggcatcgagcttac

SEQ ID NO: 564390 - DNA, 22 bp, Homo sapiens
tctttgttgattcctgtgctta

SEQ ID NO: 564391 - DNA, 22 bp, Homo sapiens
cttctgcagggactttgttcag

SEQ ID NO: 564392 - DNA, 22 bp, Homo sapiens
tggagaagggaccgggaaggaa

SEQ ID NO: 564393 - DNA, 22 bp, Homo sapiens
ttccttttttggagtctccatg

SEQ ID NO: 564394 - DNA, 22 bp, Homo sapiens
tttggggggctacacggccctt

SEQ ID NO: 564395 - DNA, 22 bp, Homo sapiens
aagtgagtcccgagtgccgcgc

SEQ ID NO: 564396 - DNA, 22 bp, Homo sapiens
ttccttgctggtgtccaacctt

SEQ ID NO: 564397 - DNA, 22 bp, Homo sapiens
tggagcaggtagggtggaggcc

SEQ ID NO: 564398 - DNA, 22 bp, Homo sapiens
tttgtgccaggatttaataaga

SEQ ID NO: 564399 - DNA, 22 bp, Homo sapiens
gagactagcttatacataaaat

SEQ ID NO: 564400 - DNA, 22 bp, Homo sapiens
ttcctacaggaggttcccctta

SEQ ID NO: 564401 - DNA, 22 bp, Homo sapiens
tgagtcacccaggtgataacat

SEQ ID NO: 564402 - DNA, 22 bp, Homo sapiens
gactggggatgggggtgggcaa

SEQ ID NO: 564403 - DNA, 22 bp, Homo sapiens
tgtaaatatcattgtactgggc

SEQ ID NO: 564404 - DNA, 22 bp, Homo sapiens
tttgataagctgacatgggaca

SEQ ID NO: 564405 - DNA, 22 bp, Homo sapiens
tttagagagacagaccacttca

SEQ ID NO: 564406 - DNA, 22 bp, Homo sapiens
gctggtacaccttgcctgtcag

SEQ ID NO: 564407 - DNA, 22 bp, Homo sapiens
tgtccttccttgcttgcagttt

SEQ ID NO: 564408 - DNA, 22 bp, Homo sapiens
tgctgtctgtggagcctgaagt

SEQ ID NO: 564409 - DNA, 22 bp, Homo sapiens
gagcaggaatagaagctctgtt

SEQ ID NO: 564410 - DNA, 22 bp, Homo sapiens
tcaccctcattttttggagtca

SEQ ID NO: 564411 - DNA, 22 bp, Homo sapiens
tgaatgctgatgaagtgtccag

SEQ ID NO: 564412 - DNA, 22 bp, Homo sapiens
ggtttggggagcactcatagaa

SEQ ID NO: 564413 - DNA, 22 bp, Homo sapiens
tttgccaggagtttcactccaa

SEQ ID NO: 564414 - DNA, 22 bp, Homo sapiens
ttttatggaaggtgtggggagc

SEQ ID NO: 564415 - DNA, 22 bp, Homo sapiens
tcttactacagggcaacccttt

SEQ ID NO: 564416 - DNA, 22 bp, Homo sapiens
attagattaagtagtgatttat

SEQ ID NO: 564417 - DNA, 22 bp, Homo sapiens
tcctttatcacttgctgtgaat

SEQ ID NO: 564418 - DNA, 22 bp, Homo sapiens
gctaacaagaccctgaactgct

SEQ ID NO: 564419 - DNA, 22 bp, Homo sapiens
tcagcctctgtgaattgaagag

SEQ ID NO: 564420 - DNA, 22 bp, Homo sapiens
ccccctcagtccaccagagccc

SEQ ID NO: 564421 - DNA, 22 bp, Homo sapiens
ttcaggacggttggctgaatgg

SEQ ID NO: 564422 - DNA, 22 bp, Homo sapiens
tagcagatccaggaatagaagc

SEQ ID NO: 564423 - DNA, 22 bp, Homo sapiens
taagatagttctgtatattctt

SEQ ID NO: 564424 - DNA, 22 bp, Homo sapiens
tcaaaggatattgggggtcata

SEQ ID NO: 564425 - DNA, 22 bp, Homo sapiens
agctacttctaaacctaaacag

SEQ ID NO: 564426 - DNA, 22 bp, Homo sapiens
tcctttgtccgccctgccctcc

SEQ ID NO: 564427 - DNA, 22 bp, Homo sapiens
aggcgggagaagcagccgggcc

SEQ ID NO: 564428 - DNA, 22 bp, Homo sapiens
tgggtgtgggcaggctggacag

SEQ ID NO: 564429 - DNA, 22 bp, Homo sapiens
ggctctcttcagagttggaaac

SEQ ID NO: 564430 - DNA, 22 bp, Homo sapiens
ttttttgccaggttgtgctttc

SEQ ID NO: 564431 - DNA, 22 bp, Homo sapiens
tggaaagatctcttgcttgtta

SEQ ID NO: 564432 - DNA, 22 bp, Homo sapiens
tgaagaataatatcaatgagca

SEQ ID NO: 564433 - DNA, 22 bp, Homo sapiens
tatggggagggctcagtcaggc

SEQ ID NO: 564434 - DNA, 22 bp, Homo sapiens
tgcactgaggaagtactgaagg

SEQ ID NO: 564435 - DNA, 22 bp, Homo sapiens
tgacccacatcgcctgcctgac

SEQ ID NO: 564436 - DNA, 22 bp, Homo sapiens
agctacaagtgttttggtttta

SEQ ID NO: 564437 - DNA, 22 bp, Homo sapiens
gctgggctcctccgtttgtgct

SEQ ID NO: 564438 - DNA, 22 bp, Homo sapiens
cgcatgcggggcgcggacgctc

SEQ ID NO: 564439 - DNA, 22 bp, Homo sapiens
gctccagtaaccctttggtgtc

SEQ ID NO: 564440 - DNA, 22 bp, Homo sapiens
ttacagggctggtttgtcaaac

SEQ ID NO: 564441 - DNA, 22 bp, Homo sapiens
cagtgctcagttcagactgtcc

SEQ ID NO: 564442 - DNA, 22 bp, Homo sapiens
ttgcttaagatcacagagctaa

SEQ ID NO: 564443 - DNA, 22 bp, Homo sapiens
ttttccgtttttggtcttcaag

SEQ ID NO: 564444 - DNA, 22 bp, Homo sapiens
tgggcttcctgaatctattgag

SEQ ID NO: 564445 - DNA, 22 bp, Homo sapiens
tgtcctagtccatgatgcctgg

SEQ ID NO: 564446 - DNA, 22 bp, Homo sapiens
tgcctcctctcctggtctaagc

SEQ ID NO: 564447 - DNA, 22 bp, Homo sapiens
ttttattcaggagaggtcactg

SEQ ID NO: 564448 - DNA, 22 bp, Homo sapiens
gcattggctgttcccaaatgtg

SEQ ID NO: 564449 - DNA, 22 bp, Homo sapiens
tggcacttctctccttgtaagt

SEQ ID NO: 564450 - DNA, 22 bp, Homo sapiens
gaaaagttattgtcagcatgtg

SEQ ID NO: 564451 - DNA, 22 bp, Homo sapiens
ttcccagcactgctaagcaaag

SEQ ID NO: 564452 - DNA, 22 bp, Homo sapiens
gaacagcataggctggctcctt

SEQ ID NO: 564453 - DNA, 22 bp, Homo sapiens
ggtgttcagtaagtgtgttggc

SEQ ID NO: 564454 - DNA, 22 bp, Homo sapiens
ttttctattgcaaatgggtgta

SEQ ID NO: 564455 - DNA, 22 bp, Homo sapiens
tgcactcgcttccttgggctgt

SEQ ID NO: 564456 - DNA, 22 bp, Homo sapiens
ttctttaatgtctacatcagca

SEQ ID NO: 564457 - DNA, 22 bp, Homo sapiens
cgagaaaagggaaggctcccag

SEQ ID NO: 564458 - DNA, 22 bp, Homo sapiens
ccaaaataatagagaagaggtg

SEQ ID NO: 564459 - DNA, 22 bp, Homo sapiens
tggcgcgtgggggggtcagctg

SEQ ID NO: 564460 - DNA, 22 bp, Homo sapiens
agggatctggggcagatggtgg

SEQ ID NO: 564461 - DNA, 22 bp, Homo sapiens
ttaaattactaggtacctagtg

SEQ ID NO: 564462 - DNA, 22 bp, Homo sapiens
tagagaggccggtgggagatgc

SEQ ID NO: 564463 - DNA, 22 bp, Homo sapiens
agaaacagaatatggtgtgaca

SEQ ID NO: 564464 - DNA, 22 bp, Homo sapiens
tagcagtgatcttgcatgttgg

SEQ ID NO: 564465 - DNA, 22 bp, Homo sapiens
ttgagtcaggcctcggtctcct

SEQ ID NO: 564466 - DNA, 22 bp, Homo sapiens
aggtgcgtttcttggtggtggc

SEQ ID NO: 564467 - DNA, 22 bp, Homo sapiens
cgctttgctcagccagtgtaga

SEQ ID NO: 564468 - DNA, 22 bp, Homo sapiens
gtctggagtagagtctagctgg

SEQ ID NO: 564469 - DNA, 22 bp, Homo sapiens
ttgtgaaggatttaggctccac

SEQ ID NO: 564470 - DNA, 22 bp, Homo sapiens
cggctccaccgggcaggggcac

SEQ ID NO: 564471 - DNA, 22 bp, Homo sapiens
ggagcgagcagctatttgctag

SEQ ID NO: 564472 - DNA, 22 bp, Homo sapiens
agaagaggatcttgcaggtcca

SEQ ID NO: 564473 - DNA, 22 bp, Homo sapiens
ccacagttggcctgtgctgacc

SEQ ID NO: 564474 - DNA, 22 bp, Homo sapiens
tgggagggggctgtgtgcacct

SEQ ID NO: 564475 - DNA, 22 bp, Homo sapiens
tcattagcatgggcacagggga

SEQ ID NO: 564476 - DNA, 22 bp, Homo sapiens
catggaggcagacagacgtggg

SEQ ID NO: 564477 - DNA, 22 bp, Homo sapiens
attcagttcgatgtgcagttct

SEQ ID NO: 564478 - DNA, 22 bp, Homo sapiens
aagtggcttttaagcaattaga

SEQ ID NO: 564479 - DNA, 22 bp, Homo sapiens
gcctggggttctggctctgtcc

SEQ ID NO: 564480 - DNA, 22 bp, Homo sapiens
ggttatttagggttaccacctg

SEQ ID NO: 564481 - DNA, 22 bp, Homo sapiens
aaccagcatgaaaccttgagca

SEQ ID NO: 564482 - DNA, 22 bp, Homo sapiens
ttgtgccaggaattgtgcatat

SEQ ID NO: 564483 - DNA, 22 bp, Homo sapiens
cagtgggaggagggctggggtc

SEQ ID NO: 564484 - DNA, 22 bp, Homo sapiens
tacacccaacccgcccccttcc

SEQ ID NO: 564485 - DNA, 22 bp, Homo sapiens
tgcgcgcaacctctggggcaac

SEQ ID NO: 564486 - DNA, 22 bp, Homo sapiens
agtggagctaggcctcatcagc

SEQ ID NO: 564487 - DNA, 22 bp, Homo sapiens
ctgccagccctagacctgctgg

SEQ ID NO: 564488 - DNA, 22 bp, Homo sapiens
gcggaatttcatcaactccctt

SEQ ID NO: 564489 - DNA, 22 bp, Homo sapiens
tctcagttgctttcttttcctg

SEQ ID NO: 564490 - DNA, 22 bp, Homo sapiens
aatctatagtgcccggaatgtg

SEQ ID NO: 564491 - DNA, 22 bp, Homo sapiens
tacaacctccaggaggcaaaag

SEQ ID NO: 564492 - DNA, 22 bp, Homo sapiens
caatcctgtactttgaaatgat

SEQ ID NO: 564493 - DNA, 22 bp, Homo sapiens
tgctgtattttgaaaaattagg

SEQ ID NO: 564494 - DNA, 22 bp, Homo sapiens
tccatctgttggccgagggtca

SEQ ID NO: 564495 - DNA, 22 bp, Homo sapiens
ttttcctttactgagtaccaaa

SEQ ID NO: 564496 - DNA, 22 bp, Homo sapiens
gagagcggggttgggggcggac

SEQ ID NO: 564497 - DNA, 22 bp, Homo sapiens
tatgatgtcatttatctcagaa

SEQ ID NO: 564498 - DNA, 22 bp, Homo sapiens
tggagacatggaacagtgtggt

SEQ ID NO: 564499 - DNA, 22 bp, Homo sapiens
tggactttgggtcctgtggcct

SEQ ID NO: 564500 - DNA, 22 bp, Homo sapiens
cagaggcgcaaggcgcccctcc

SEQ ID NO: 564501 - DNA, 22 bp, Homo sapiens
tcgatcaagaagccggatgtgg

SEQ ID NO: 564502 - DNA, 22 bp, Homo sapiens
tggggttttctctgcatttggt

SEQ ID NO: 564503 - DNA, 22 bp, Homo sapiens
ttctcttatagactatgtgaga

SEQ ID NO: 564504 - DNA, 22 bp, Homo sapiens
tcctccatttagccgtgtggcc

SEQ ID NO: 564505 - DNA, 22 bp, Homo sapiens
cgggcctggaataagaggaaga

SEQ ID NO: 564506 - DNA, 22 bp, Homo sapiens
ttttcaaactagcaacacctca

SEQ ID NO: 564507 - DNA, 22 bp, Homo sapiens
tctctcaggactccatccttct

SEQ ID NO: 564508 - DNA, 22 bp, Homo sapiens
ttctctcccagctctggtctaa

SEQ ID NO: 564509 - DNA, 22 bp, Homo sapiens
cctggtagtaaatgagtagagc

SEQ ID NO: 564510 - DNA, 22 bp, Homo sapiens
tcaccttgaggtcgcacagcag

SEQ ID NO: 564511 - DNA, 22 bp, Homo sapiens
agaaggaaaataagcttttcaa

SEQ ID NO: 564512 - DNA, 22 bp, Homo sapiens
catcacttcctctctgagcctc

SEQ ID NO: 564513 - DNA, 22 bp, Homo sapiens
gccaaaccagatcattcaggcc

SEQ ID NO: 564514 - DNA, 22 bp, Homo sapiens
tttcaaacctagggacattgga

SEQ ID NO: 564515 - DNA, 22 bp, Homo sapiens
tgtggaaatgggttggatggag

SEQ ID NO: 564516 - DNA, 22 bp, Homo sapiens
tttctctctggacttattcttt

SEQ ID NO: 564517 - DNA, 22 bp, Homo sapiens
tgagaggaggggagggtcctgg

SEQ ID NO: 564518 - DNA, 22 bp, Homo sapiens
ggcccctcctcctgggccctcc

SEQ ID NO: 564519 - DNA, 22 bp, Homo sapiens
gtaaacaaagtgtttgccctta

SEQ ID NO: 564520 - DNA, 22 bp, Homo sapiens
ttctgtacataagtaatctgat

SEQ ID NO: 564521 - DNA, 22 bp, Homo sapiens
gctccgagactgagcggcggct

SEQ ID NO: 564522 - DNA, 22 bp, Homo sapiens
accctttctcttgcctttctca

SEQ ID NO: 564523 - DNA, 22 bp, Homo sapiens
ttgtagtgcttattgccattag

SEQ ID NO: 564524 - DNA, 22 bp, Homo sapiens
gtctcacccacgcttgatttca

SEQ ID NO: 564525 - DNA, 22 bp, Homo sapiens
tttctcctggggtaccggtggg

SEQ ID NO: 564526 - DNA, 22 bp, Homo sapiens
ggcatttccttctattgacttc

SEQ ID NO: 564527 - DNA, 22 bp, Homo sapiens
ttttctgccaggagggaacact

SEQ ID NO: 564528 - DNA, 22 bp, Homo sapiens
gcatctggcctcctgcctgatt

SEQ ID NO: 564529 - DNA, 22 bp, Homo sapiens
catagaacagtcttctgagcca

SEQ ID NO: 564530 - DNA, 22 bp, Homo sapiens
tggtcctagtttgttattgtag

SEQ ID NO: 564531 - DNA, 22 bp, Homo sapiens
tagcggaatgtcctggaaacta

SEQ ID NO: 564532 - DNA, 22 bp, Homo sapiens
actcaagtaagaaacagaattg

SEQ ID NO: 564533 - DNA, 22 bp, Homo sapiens
tttgaggtcaccaaggtaccat

SEQ ID NO: 564534 - DNA, 22 bp, Homo sapiens
tacctgagacccggtccaggag

SEQ ID NO: 564535 - DNA, 22 bp, Homo sapiens
gggcccgtgtgagtgaagtgtt

SEQ ID NO: 564536 - DNA, 22 bp, Homo sapiens
tctacttctacctgtgttatca

SEQ ID NO: 564537 - DNA, 22 bp, Homo sapiens
tgagtttatgtgaagagagggt

SEQ ID NO: 564538 - DNA, 22 bp, Homo sapiens
ttctctagaatccagcccaatt

SEQ ID NO: 564539 - DNA, 22 bp, Homo sapiens
agagagggccatggcaggaggg

SEQ ID NO: 564540 - DNA, 22 bp, Homo sapiens
gcgcttgggccccggcgttccc

SEQ ID NO: 564541 - DNA, 22 bp, Homo sapiens
cacactttaggagttaatgcca

SEQ ID NO: 564542 - DNA, 22 bp, Homo sapiens
gctagtcagagacagacctagg

SEQ ID NO: 564543 - DNA, 22 bp, Homo sapiens
tccattgtaaatagcattaaag

SEQ ID NO: 564544 - DNA, 22 bp, Homo sapiens
tctgggcccccagccacctggg

SEQ ID NO: 564545 - DNA, 22 bp, Homo sapiens
aggagacagaaccatcctggga

SEQ ID NO: 564546 - DNA, 22 bp, Homo sapiens
aggccctgctgtagtgcttact

SEQ ID NO: 564547 - DNA, 22 bp, Homo sapiens
tgaggtgttttgtgaggcgagc

SEQ ID NO: 564548 - DNA, 22 bp, Homo sapiens
gattcgtctttcaattttataa

SEQ ID NO: 564549 - DNA, 22 bp, Homo sapiens
tggatggagccaaggcttggag

SEQ ID NO: 564550 - DNA, 22 bp, Homo sapiens
gaggttttctgggtttctgttt

SEQ ID NO: 564551 - DNA, 22 bp, Homo sapiens
tttgattattctccatcctaat

SEQ ID NO: 564552 - DNA, 22 bp, Homo sapiens
cctggggtgggggcagagagat

SEQ ID NO: 564553 - DNA, 22 bp, Homo sapiens
ttttctgccccacatggtgcgc

SEQ ID NO: 564554 - DNA, 22 bp, Homo sapiens
agagtggaatgtcgtgtaaaaa

SEQ ID NO: 564555 - DNA, 22 bp, Homo sapiens
tataatcaggagaagagagtgt

SEQ ID NO: 564556 - DNA, 22 bp, Homo sapiens
gacattagagctaagtttttgg

SEQ ID NO: 564557 - DNA, 22 bp, Homo sapiens
gcagtggtcagggacctcaaga

SEQ ID NO: 564558 - DNA, 22 bp, Homo sapiens
cacacttttggagttagtgcca

SEQ ID NO: 564559 - DNA, 22 bp, Homo sapiens
tcgggtgttcagtaaatgtaag

SEQ ID NO: 564560 - DNA, 22 bp, Homo sapiens
ccctcttccctgcagccacggc

SEQ ID NO: 564561 - DNA, 22 bp, Homo sapiens
aggcagctggcatcctaaggat

SEQ ID NO: 564562 - DNA, 22 bp, Homo sapiens
gctctctgcctgggaataattt

SEQ ID NO: 564563 - DNA, 22 bp, Homo sapiens
ttaggccttcttccctgttgct

SEQ ID NO: 564564 - DNA, 22 bp, Homo sapiens
tataattccctctgacattgac

SEQ ID NO: 564565 - DNA, 22 bp, Homo sapiens
agtgacaaagattctccttgtt

SEQ ID NO: 564566 - DNA, 22 bp, Homo sapiens
tgaatttgatagtcttggctgt

SEQ ID NO: 564567 - DNA, 22 bp, Homo sapiens
tttgtggggagagaggggggtg

SEQ ID NO: 564568 - DNA, 22 bp, Homo sapiens
tcctaagagagggcagatgtga

SEQ ID NO: 564569 - DNA, 22 bp, Homo sapiens
ggccaaatctcagctccagtca

SEQ ID NO: 564570 - DNA, 22 bp, Homo sapiens
tgatgagctctgttcacttttg

SEQ ID NO: 564571 - DNA, 22 bp, Homo sapiens
taatgtgagttatctaagtaca

SEQ ID NO: 564572 - DNA, 22 bp, Homo sapiens
tggcagcactatgcaggatgtt

SEQ ID NO: 564573 - DNA, 22 bp, Homo sapiens
tccattcagaggaagctggggg

SEQ ID NO: 564574 - DNA, 22 bp, Homo sapiens
tggactttcaagtacccagagg

SEQ ID NO: 564575 - DNA, 22 bp, Homo sapiens
tagacagcagagagagtgcagg

SEQ ID NO: 564576 - DNA, 22 bp, Homo sapiens
tgtcagaaatgatttttctgac

SEQ ID NO: 564577 - DNA, 22 bp, Homo sapiens
tataacttgctagttatactac

SEQ ID NO: 564578 - DNA, 22 bp, Homo sapiens
tgggttatttttcctctcatct

SEQ ID NO: 564579 - DNA, 22 bp, Homo sapiens
aaaaatagatcaaatggtggtg

SEQ ID NO: 564580 - DNA, 22 bp, Homo sapiens
aagaccccatttaacttgaaac

SEQ ID NO: 564581 - DNA, 22 bp, Homo sapiens
tcgctggattccgacaaaggga

SEQ ID NO: 564582 - DNA, 22 bp, Homo sapiens
ttccatctccgttctctttcta

SEQ ID NO: 564583 - DNA, 22 bp, Homo sapiens
acagcctcatgcccgctcagaa

SEQ ID NO: 564584 - DNA, 22 bp, Homo sapiens
tcagagcttgggaagataacta

SEQ ID NO: 564585 - DNA, 22 bp, Homo sapiens
tattgctgctgtctcagctgtt

SEQ ID NO: 564586 - DNA, 22 bp, Homo sapiens
tcattaggaggaggctgtcaga

SEQ ID NO: 564587 - DNA, 22 bp, Homo sapiens
gatgtgtgctgtgtgccgggac

SEQ ID NO: 564588 - DNA, 22 bp, Homo sapiens
ggctggctctgggcctcagaca

SEQ ID NO: 564589 - DNA, 22 bp, Homo sapiens
tttcagctactacctctattag

SEQ ID NO: 564590 - DNA, 22 bp, Homo sapiens
ggtgtgcacttatttcagtcag

SEQ ID NO: 564591 - DNA, 22 bp, Homo sapiens
tgggcaggggtgggggatcacg

SEQ ID NO: 564592 - DNA, 22 bp, Homo sapiens
ttcaaactgagcttcaagtggc

SEQ ID NO: 564593 - DNA, 22 bp, Homo sapiens
tgaaggagtgatatttgttgtt

SEQ ID NO: 564594 - DNA, 22 bp, Homo sapiens
tatatttcttctttggcagttc

SEQ ID NO: 564595 - DNA, 22 bp, Homo sapiens
tctccatttcctcccaccctcc

SEQ ID NO: 564596 - DNA, 22 bp, Homo sapiens
tgtggtacatgctggaagttgc

SEQ ID NO: 564597 - DNA, 22 bp, Homo sapiens
ctcgggcgccggccacgctacc

SEQ ID NO: 564598 - DNA, 22 bp, Homo sapiens
gagtcaggcaggagggccaggt

SEQ ID NO: 564599 - DNA, 22 bp, Homo sapiens
gagtcagtattctagctcttgc

SEQ ID NO: 564600 - DNA, 22 bp, Homo sapiens
gcggcggccagagctcccgggg

SEQ ID NO: 564601 - DNA, 22 bp, Homo sapiens
ggtggggacggtagtgtggttg

SEQ ID NO: 564602 - DNA, 22 bp, Homo sapiens
gattaaacattaaactgcagat

SEQ ID NO: 564603 - DNA, 22 bp, Homo sapiens
tcctgtaatagtgattctccac

SEQ ID NO: 564604 - DNA, 22 bp, Homo sapiens
tcagaagaggaggcggcttgac

SEQ ID NO: 564605 - DNA, 22 bp, Homo sapiens
tattgcactataagttgtaatg

SEQ ID NO: 564606 - DNA, 22 bp, Homo sapiens
ccaggtacatcattagccaact

SEQ ID NO: 564607 - DNA, 22 bp, Homo sapiens
aggcagtgtcagacagatggta

SEQ ID NO: 564608 - DNA, 22 bp, Homo sapiens
agggagtaactgatggtggaaa

SEQ ID NO: 564609 - DNA, 22 bp, Homo sapiens
tgggcaggtgggaggatcctgg

SEQ ID NO: 564610 - DNA, 22 bp, Homo sapiens
gaggtctcggccttcattcaca

SEQ ID NO: 564611 - DNA, 22 bp, Homo sapiens
tatattccagagggtagggctg

SEQ ID NO: 564612 - DNA, 22 bp, Homo sapiens
cactcttatttgcaactggctc

SEQ ID NO: 564613 - DNA, 22 bp, Homo sapiens
tcacagggccttggcctcctct

SEQ ID NO: 564614 - DNA, 22 bp, Homo sapiens
aagagacagcatggagctgata

SEQ ID NO: 564615 - DNA, 22 bp, Homo sapiens
tagttaacttctttcaccagga

SEQ ID NO: 564616 - DNA, 22 bp, Homo sapiens
taagtcatgattctgtgttact

SEQ ID NO: 564617 - DNA, 22 bp, Homo sapiens
tgttcctcagcattctctgtaa

SEQ ID NO: 564618 - DNA, 22 bp, Homo sapiens
tgagggttcacactctcccacc

SEQ ID NO: 564619 - DNA, 22 bp, Homo sapiens
tctcacttctgagctctggtta

SEQ ID NO: 564620 - DNA, 22 bp, Homo sapiens
tgtgagagtgttttagggagag

SEQ ID NO: 564621 - DNA, 22 bp, Homo sapiens
tgaggctcctagagattggcat

SEQ ID NO: 564622 - DNA, 22 bp, Homo sapiens
tccttcagtttttatttttcag

SEQ ID NO: 564623 - DNA, 22 bp, Homo sapiens
ccgccacctccgtctgctcctc

SEQ ID NO: 564624 - DNA, 22 bp, Homo sapiens
ttttctcatgtgccagattttt

SEQ ID NO: 564625 - DNA, 22 bp, Homo sapiens
ttccttccctaagattcccaac

SEQ ID NO: 564626 - DNA, 22 bp, Homo sapiens
cctcagagcagtggagggcagg

SEQ ID NO: 564627 - DNA, 22 bp, Homo sapiens
cagaagcaagggccaaagtctt

SEQ ID NO: 564628 - DNA, 22 bp, Homo sapiens
gccatttgtctttgtaagtaat

SEQ ID NO: 564629 - DNA, 22 bp, Homo sapiens
acttttacactcttgttctcac

SEQ ID NO: 564630 - DNA, 22 bp, Homo sapiens
gacctcttccacagtcccctct

SEQ ID NO: 564631 - DNA, 22 bp, Homo sapiens
agaggttgagagcatggattct

SEQ ID NO: 564632 - DNA, 22 bp, Homo sapiens
ttgccaagaccatgtgttggga

SEQ ID NO: 564633 - DNA, 22 bp, Homo sapiens
tgtggcagcatcatggtgtcca

SEQ ID NO: 564634 - DNA, 22 bp, Homo sapiens
aactgtaaaagaaaggtgtcac

SEQ ID NO: 564635 - DNA, 22 bp, Homo sapiens
gtgattatttacagtttaggtg

SEQ ID NO: 564636 - DNA, 22 bp, Homo sapiens
cttacccagtttccccaattgc

SEQ ID NO: 564637 - DNA, 22 bp, Homo sapiens
cagggcaggcaggccagcggct

SEQ ID NO: 564638 - DNA, 22 bp, Homo sapiens
ccaggagaggtctctgtgtctc

SEQ ID NO: 564639 - DNA, 22 bp, Homo sapiens
gacttttcgagataacaggttt

SEQ ID NO: 564640 - DNA, 22 bp, Homo sapiens
gaaagggaatgacccagttaga

SEQ ID NO: 564641 - DNA, 22 bp, Homo sapiens
tcttgctggtctcagaaatggg

SEQ ID NO: 564642 - DNA, 22 bp, Homo sapiens
ttttatgtgtagctttaaaagg

SEQ ID NO: 564643 - DNA, 22 bp, Homo sapiens
aaagaaccctgggcctcatgcg

SEQ ID NO: 564644 - DNA, 22 bp, Homo sapiens
ccactttaatagatgatacatt

SEQ ID NO: 564645 - DNA, 22 bp, Homo sapiens
tgggcatcaacccccatccagg

SEQ ID NO: 564646 - DNA, 22 bp, Homo sapiens
aacatgctgggcctccgatctc

SEQ ID NO: 564647 - DNA, 22 bp, Homo sapiens
ttctctccctgaagcacttgtt

SEQ ID NO: 564648 - DNA, 22 bp, Homo sapiens
gcacagcacagcggtgactcag

SEQ ID NO: 564649 - DNA, 22 bp, Homo sapiens
aggtgagcagtaaatatttgtt

SEQ ID NO: 564650 - DNA, 22 bp, Homo sapiens
tacaaagcagaagtattttttt

SEQ ID NO: 564651 - DNA, 22 bp, Homo sapiens
gaaaaggtatatggtgggtgga

SEQ ID NO: 564652 - DNA, 22 bp, Homo sapiens
tgcgctttccctcttctgccac

SEQ ID NO: 564653 - DNA, 22 bp, Homo sapiens
gctggtgtagctcctttagagt

SEQ ID NO: 564654 - DNA, 22 bp, Homo sapiens
ggtccactcccatctgttttct

SEQ ID NO: 564655 - DNA, 22 bp, Homo sapiens
gcagtggggccagctcccgccc

SEQ ID NO: 564656 - DNA, 22 bp, Homo sapiens
ttgttcctccattacactgtcc

SEQ ID NO: 564657 - DNA, 22 bp, Homo sapiens
tcccagatactgtgtcttaact

SEQ ID NO: 564658 - DNA, 22 bp, Homo sapiens
agacattattttgtttgtgtta

SEQ ID NO: 564659 - DNA, 22 bp, Homo sapiens
catctgcccagacacagccctg

SEQ ID NO: 564660 - DNA, 22 bp, Homo sapiens
ttccaaatgatttttcatcccc

SEQ ID NO: 564661 - DNA, 22 bp, Homo sapiens
tgctctccttgccagcacctgc

SEQ ID NO: 564662 - DNA, 22 bp, Homo sapiens
agcttcacgcttggatcttctc

SEQ ID NO: 564663 - DNA, 22 bp, Homo sapiens
gtgggtacagtggggagtgacc

SEQ ID NO: 564664 - DNA, 22 bp, Homo sapiens
atcatgtgtggttgtgtgtttg

SEQ ID NO: 564665 - DNA, 22 bp, Homo sapiens
agaggttttggtaaccattgca

SEQ ID NO: 564666 - DNA, 22 bp, Homo sapiens
gaaccctatcaatattgtctct

SEQ ID NO: 564667 - DNA, 22 bp, Homo sapiens
tgaagtgtctcttgtaaaagat

SEQ ID NO: 564668 - DNA, 22 bp, Homo sapiens
gaagcatgaaagcttaggcaac

SEQ ID NO: 564669 - DNA, 22 bp, Homo sapiens
tcattcttgtttgctttggtta

SEQ ID NO: 564670 - DNA, 22 bp, Homo sapiens
tgagggggtgactcagagtgtg

SEQ ID NO: 564671 - DNA, 22 bp, Homo sapiens
ttttctagcccttcacactact

SEQ ID NO: 564672 - DNA, 22 bp, Homo sapiens
cgagataagatagtgctgtccc

SEQ ID NO: 564673 - DNA, 22 bp, Homo sapiens
cctttgggttgtgacttgggtt

SEQ ID NO: 564674 - DNA, 22 bp, Homo sapiens
gctgtttacatgaaaaatgctc

SEQ ID NO: 564675 - DNA, 22 bp, Homo sapiens
tctgcctccactgccaccatgg

SEQ ID NO: 564676 - DNA, 22 bp, Homo sapiens
tccctttgctgttgatgatgtg

SEQ ID NO: 564677 - DNA, 22 bp, Homo sapiens
cagatgtacagaaatgctacac

SEQ ID NO: 564678 - DNA, 22 bp, Homo sapiens
tcgtgcatccctttagagtgtt

SEQ ID NO: 564679 - DNA, 22 bp, Homo sapiens
cactcaataaatagtcattggt

SEQ ID NO: 564680 - DNA, 22 bp, Homo sapiens
taacaccctaagccattaggtc

SEQ ID NO: 564681 - DNA, 22 bp, Homo sapiens
tggaaggaggtgggtgggaaga

SEQ ID NO: 564682 - DNA, 22 bp, Homo sapiens
tgaagctggaaggagttgatag

SEQ ID NO: 564683 - DNA, 22 bp, Homo sapiens
ttcagtgccagagtgggaggat

SEQ ID NO: 564684 - DNA, 22 bp, Homo sapiens
tgtacacatttgaaaggttgat

SEQ ID NO: 564685 - DNA, 22 bp, Homo sapiens
tccaagccacattctccatgac

SEQ ID NO: 564686 - DNA, 22 bp, Homo sapiens
aacacagagaataacaggactt

SEQ ID NO: 564687 - DNA, 22 bp, Homo sapiens
tataatgaatgtgaaaatcagc

SEQ ID NO: 564688 - DNA, 22 bp, Homo sapiens
tcttgggagccagctctctggg

SEQ ID NO: 564689 - DNA, 22 bp, Homo sapiens
cctaagagcaacggggtgcatt

SEQ ID NO: 564690 - DNA, 22 bp, Homo sapiens
tccttgtaaccaaactcattaa

SEQ ID NO: 564691 - DNA, 22 bp, Homo sapiens
tagcccacttgggagaggagag

SEQ ID NO: 564692 - DNA, 22 bp, Homo sapiens
caaagtgccgacccactgagaa

SEQ ID NO: 564693 - DNA, 22 bp, Homo sapiens
gcctgggcctggcgcggggggt

SEQ ID NO: 564694 - DNA, 22 bp, Homo sapiens
caggactggggagcggaaggtg

SEQ ID NO: 564695 - DNA, 22 bp, Homo sapiens
tgctgtccagaaacctgactct

SEQ ID NO: 564696 - DNA, 22 bp, Homo sapiens
tggtgaagctgttggtctccaa

SEQ ID NO: 564697 - DNA, 22 bp, Homo sapiens
caagcattctctgcctagaagt

SEQ ID NO: 564698 - DNA, 22 bp, Homo sapiens
ttcttgtatccctcaaggctgt

SEQ ID NO: 564699 - DNA, 22 bp, Homo sapiens
atcggtctcttctgcacttttc

SEQ ID NO: 564700 - DNA, 22 bp, Homo sapiens
tgagtctctgtaggactctcag

SEQ ID NO: 564701 - DNA, 22 bp, Homo sapiens
ccaggtcactccattcatatat

SEQ ID NO: 564702 - DNA, 22 bp, Homo sapiens
ttgctgttccctttcagtctct

SEQ ID NO: 564703 - DNA, 22 bp, Homo sapiens
ggggggtgcttcctcattagga

SEQ ID NO: 564704 - DNA, 22 bp, Homo sapiens
gagggtaggttctgttggttga

SEQ ID NO: 564705 - DNA, 22 bp, Homo sapiens
ccagttataacgtacactatgc

SEQ ID NO: 564706 - DNA, 22 bp, Homo sapiens
ttgatccaagtgcggaactccc

SEQ ID NO: 564707 - DNA, 22 bp, Homo sapiens
tggttctgcaagtgctgagggt

SEQ ID NO: 564708 - DNA, 22 bp, Homo sapiens
tttctgtggccagtcactggag

SEQ ID NO: 564709 - DNA, 22 bp, Homo sapiens
cagtcaatattttcacttggat

SEQ ID NO: 564710 - DNA, 22 bp, Homo sapiens
acaagggtggcacagtggggga

SEQ ID NO: 564711 - DNA, 22 bp, Homo sapiens
ttgcttcttaactttatcaaac

SEQ ID NO: 564712 - DNA, 22 bp, Homo sapiens
gcctctggggggttttgatgga

SEQ ID NO: 564713 - DNA, 22 bp, Homo sapiens
tcccacttccctacttccttcc

SEQ ID NO: 564714 - DNA, 22 bp, Homo sapiens
gctggagtggatgatagaggtg

SEQ ID NO: 564715 - DNA, 22 bp, Homo sapiens
ttctcccactacccagcatggt

SEQ ID NO: 564716 - DNA, 22 bp, Homo sapiens
ttgtttctattgaatgcatttc

SEQ ID NO: 564717 - DNA, 22 bp, Homo sapiens
cctcacctctctggggccctat

SEQ ID NO: 564718 - DNA, 22 bp, Homo sapiens
agaggagccctttcttctttgt

SEQ ID NO: 564719 - DNA, 22 bp, Homo sapiens
tttagtaggcacctactgtgtg

SEQ ID NO: 564720 - DNA, 22 bp, Homo sapiens
ggaggtggaggggagcaggatt

SEQ ID NO: 564721 - DNA, 22 bp, Homo sapiens
gtgtcttggatatctatggctt

SEQ ID NO: 564722 - DNA, 22 bp, Homo sapiens
cacaccttcccccttgctcaag

SEQ ID NO: 564723 - DNA, 22 bp, Homo sapiens
ggtctggtcccctgttgcccat

SEQ ID NO: 564724 - DNA, 22 bp, Homo sapiens
taggcactgtttttgctgaggt

SEQ ID NO: 564725 - DNA, 22 bp, Homo sapiens
tgaagtgtccagatttatactg

SEQ ID NO: 564726 - DNA, 22 bp, Homo sapiens
tactcctgctgtcactgcagtt

SEQ ID NO: 564727 - DNA, 22 bp, Homo sapiens
cctccctcaggttcttccctga

SEQ ID NO: 564728 - DNA, 22 bp, Homo sapiens
ttagtgcatggttggtgctcaa

SEQ ID NO: 564729 - DNA, 22 bp, Homo sapiens
caggggcaggagaaggcagagg

SEQ ID NO: 564730 - DNA, 22 bp, Homo sapiens
tcttcccataccggtacacagg

SEQ ID NO: 564731 - DNA, 22 bp, Homo sapiens
agccccagcctccctcccccag

SEQ ID NO: 564732 - DNA, 22 bp, Homo sapiens
gcctgggcctggcatgggaggt

SEQ ID NO: 564733 - DNA, 22 bp, Homo sapiens
tgaggccatttgaagtgtgaga

SEQ ID NO: 564734 - DNA, 22 bp, Homo sapiens
tatggagatgggaattagtgag

SEQ ID NO: 564735 - DNA, 22 bp, Homo sapiens
cactgtacaggaaggctccagg

SEQ ID NO: 564736 - DNA, 22 bp, Homo sapiens
gctgagacatggagtagagcct

SEQ ID NO: 564737 - DNA, 22 bp, Homo sapiens
tgaactgagatacagagttatt

SEQ ID NO: 564738 - DNA, 22 bp, Homo sapiens
attggtgagtcacaatatatta

SEQ ID NO: 564739 - DNA, 22 bp, Homo sapiens
ataagcttaaatgttccctaat

SEQ ID NO: 564740 - DNA, 22 bp, Homo sapiens
cagagtgaagtcaccgctgttg

SEQ ID NO: 564741 - DNA, 22 bp, Homo sapiens
tccctggcatgtctgactctgg

SEQ ID NO: 564742 - DNA, 22 bp, Homo sapiens
tagtttcccaactaattattct

SEQ ID NO: 564743 - DNA, 22 bp, Homo sapiens
tttggtccagagagacagctag

SEQ ID NO: 564744 - DNA, 22 bp, Homo sapiens
tgctaactagggacctggcgag

SEQ ID NO: 564745 - DNA, 22 bp, Homo sapiens
tgccctgctgcctggatggaaa

SEQ ID NO: 564746 - DNA, 22 bp, Homo sapiens
cagagaaggaagcagccagaga

SEQ ID NO: 564747 - DNA, 22 bp, Homo sapiens
tctgctgaaaggaagtagggaa

SEQ ID NO: 564748 - DNA, 22 bp, Homo sapiens
ccttcacctggtcaggcgtttt

SEQ ID NO: 564749 - DNA, 22 bp, Homo sapiens
caccgccaggccaggccctgag

SEQ ID NO: 564750 - DNA, 22 bp, Homo sapiens
tggagggtatcctcatgagggg

SEQ ID NO: 564751 - DNA, 22 bp, Homo sapiens
tataaatagtaatgctaactgt

SEQ ID NO: 564752 - DNA, 22 bp, Homo sapiens
atggcacatgtttgttgttagg

SEQ ID NO: 564753 - DNA, 22 bp, Homo sapiens
tggggcacacagatttatagtt

SEQ ID NO: 564754 - DNA, 22 bp, Homo sapiens
ttctgacactctcaggatgtgg

SEQ ID NO: 564755 - DNA, 22 bp, Homo sapiens
ctcctgacattgtcacctgaga

SEQ ID NO: 564756 - DNA, 22 bp, Homo sapiens
tggctgatcctcttcatttctc

SEQ ID NO: 564757 - DNA, 22 bp, Homo sapiens
agggcctgttctgattggcaga

SEQ ID NO: 564758 - DNA, 22 bp, Homo sapiens
cctgtgagtcactgagttttgg

SEQ ID NO: 564759 - DNA, 22 bp, Homo sapiens
tatgttctggttcagtatatta

SEQ ID NO: 564760 - DNA, 22 bp, Homo sapiens
gcagcctcttgggaggggaggt

SEQ ID NO: 564761 - DNA, 22 bp, Homo sapiens
tttgtgtgtgtgctggtttcac

SEQ ID NO: 564762 - DNA, 22 bp, Homo sapiens
tcttgacagaaatgttttaaat

SEQ ID NO: 564763 - DNA, 22 bp, Homo sapiens
tgtgggtcctgcctgccgtcag

SEQ ID NO: 564764 - DNA, 22 bp, Homo sapiens
tctcttttaatatagtaatgtg

SEQ ID NO: 564765 - DNA, 22 bp, Homo sapiens
atagtaagaaccctggagggcc

SEQ ID NO: 564766 - DNA, 22 bp, Homo sapiens
tcccagatcccagcctgcagaa

SEQ ID NO: 564767 - DNA, 22 bp, Homo sapiens
tggtggtttccttttgtctcct

SEQ ID NO: 564768 - DNA, 22 bp, Homo sapiens
aggccagcccgctcttctcatg

SEQ ID NO: 564769 - DNA, 22 bp, Homo sapiens
tgactcttcaacctcaggactt

SEQ ID NO: 564770 - DNA, 22 bp, Homo sapiens
ccctccccacccctgcagagag

SEQ ID NO: 564771 - DNA, 22 bp, Homo sapiens
ggagaggtgaaggctgccctgg

SEQ ID NO: 564772 - DNA, 22 bp, Homo sapiens
aaaggtggttcctctgtagaat

SEQ ID NO: 564773 - DNA, 22 bp, Homo sapiens
caccagctcatacagttctaaa

SEQ ID NO: 564774 - DNA, 22 bp, Homo sapiens
aatgggtaataaaagccattta

SEQ ID NO: 564775 - DNA, 22 bp, Homo sapiens
catgatactggagttgtcccat

SEQ ID NO: 564776 - DNA, 22 bp, Homo sapiens
tcttggttgatcatggactcta

SEQ ID NO: 564777 - DNA, 22 bp, Homo sapiens
caagaagtctcctgcagtctct

SEQ ID NO: 564778 - DNA, 22 bp, Homo sapiens
aggggccaggtaccctcagttc

SEQ ID NO: 564779 - DNA, 22 bp, Homo sapiens
tgggagggcccaggaggagggg

SEQ ID NO: 564780 - DNA, 22 bp, Homo sapiens
agcgagccacgggagggagtgt

SEQ ID NO: 564781 - DNA, 22 bp, Homo sapiens
gcggcactctgaaagctgccac

SEQ ID NO: 564782 - DNA, 22 bp, Homo sapiens
tgtttggaatgcatgctgtctc

SEQ ID NO: 564783 - DNA, 22 bp, Homo sapiens
tgcctggttattcctcaggcta

SEQ ID NO: 564784 - DNA, 22 bp, Homo sapiens
ccacctcgcctggcctggacca

SEQ ID NO: 564785 - DNA, 22 bp, Homo sapiens
tgttggaaaaacagacaaatgt

SEQ ID NO: 564786 - DNA, 22 bp, Homo sapiens
tcgttgcctggcgactagtccc

SEQ ID NO: 564787 - DNA, 22 bp, Homo sapiens
tgtggggctggggatatgacaa

SEQ ID NO: 564788 - DNA, 22 bp, Homo sapiens
ttctgctggaggtaagcctttt

SEQ ID NO: 564789 - DNA, 22 bp, Homo sapiens
tgaggttgagtgtgtacattta

SEQ ID NO: 564790 - DNA, 22 bp, Homo sapiens
tttagcaactagcttttctgtt

SEQ ID NO: 564791 - DNA, 22 bp, Homo sapiens
ggggcgctgctgcccatgggat

SEQ ID NO: 564792 - DNA, 22 bp, Homo sapiens
cagggaggtcctgggggcaggg

SEQ ID NO: 564793 - DNA, 22 bp, Homo sapiens
gcctggtttcccctttttttgt

SEQ ID NO: 564794 - DNA, 22 bp, Homo sapiens
tcgtggctggacaaatgagttg

SEQ ID NO: 564795 - DNA, 22 bp, Homo sapiens
tgcttgcaagtcttttgtttcc

SEQ ID NO: 564796 - DNA, 22 bp, Homo sapiens
aaagccctaggtggtcacagcc

SEQ ID NO: 564797 - DNA, 22 bp, Homo sapiens
agctctggggccgggatgagag

SEQ ID NO: 564798 - DNA, 22 bp, Homo sapiens
agagctctctggctttgcctta

SEQ ID NO: 564799 - DNA, 22 bp, Homo sapiens
tcagtctcatcaggaaagcaca

SEQ ID NO: 564800 - DNA, 22 bp, Homo sapiens
tgtgtcctccagcagtggtaca

SEQ ID NO: 564801 - DNA, 22 bp, Homo sapiens
tcaagactccacaggtgccaac

SEQ ID NO: 564802 - DNA, 22 bp, Homo sapiens
tgatatgtttgatattgggttg

SEQ ID NO: 564803 - DNA, 22 bp, Homo sapiens
tgagacatttttcaaaatacat

SEQ ID NO: 564804 - DNA, 22 bp, Homo sapiens
gtgcctcggtagggtggtatgc

SEQ ID NO: 564805 - DNA, 22 bp, Homo sapiens
aattacacccatggcagctcag

SEQ ID NO: 564806 - DNA, 22 bp, Homo sapiens
acaccataagcagagcacaaaa

SEQ ID NO: 564807 - DNA, 22 bp, Homo sapiens
tgaaattcacgctgtcttcccc

SEQ ID NO: 564808 - DNA, 22 bp, Homo sapiens
tgcccggaggtgagatgaataa

SEQ ID NO: 564809 - DNA, 22 bp, Homo sapiens
ggagacggacagcggagaagtg

SEQ ID NO: 564810 - DNA, 22 bp, Homo sapiens
tagctgtagcatctgatccact

SEQ ID NO: 564811 - DNA, 22 bp, Homo sapiens
tccctggctggtggaagggcat

SEQ ID NO: 564812 - DNA, 22 bp, Homo sapiens
caagtcctgaggttgaagagtc

SEQ ID NO: 564813 - DNA, 22 bp, Homo sapiens
cgctcggtccatttctgggcgc

SEQ ID NO: 564814 - DNA, 22 bp, Homo sapiens
cgggctctgggctccccagccc

SEQ ID NO: 564815 - DNA, 22 bp, Homo sapiens
ttttctaacaaagaagctgcat

SEQ ID NO: 564816 - DNA, 22 bp, Homo sapiens
cttaaaaagggaagcagggctt

SEQ ID NO: 564817 - DNA, 22 bp, Homo sapiens
agttcacataaattctctcatt

SEQ ID NO: 564818 - DNA, 22 bp, Homo sapiens
tgcctgttgtctgctctcgttc

SEQ ID NO: 564819 - DNA, 22 bp, Homo sapiens
tcagacaacattgggacatacg

SEQ ID NO: 564820 - DNA, 22 bp, Homo sapiens
ggcttactggaaaggccattcc

SEQ ID NO: 564821 - DNA, 22 bp, Homo sapiens
tttgaggaacagctggggtgga

SEQ ID NO: 564822 - DNA, 22 bp, Homo sapiens
caagcatatcattttgttcctg

SEQ ID NO: 564823 - DNA, 22 bp, Homo sapiens
tctcatatggaaatattgacag

SEQ ID NO: 564824 - DNA, 22 bp, Homo sapiens
tgagaaagagggtttgatggtc

SEQ ID NO: 564825 - DNA, 22 bp, Homo sapiens
ccctggtaattgacacacatgg

SEQ ID NO: 564826 - DNA, 22 bp, Homo sapiens
aagtaactggttagttacaagt

SEQ ID NO: 564827 - DNA, 22 bp, Homo sapiens
gatggagggcctggccccagcg

SEQ ID NO: 564828 - DNA, 22 bp, Homo sapiens
tggccacattctgggtctaagg

SEQ ID NO: 564829 - DNA, 22 bp, Homo sapiens
ggcagggtgcgttagctttgag

SEQ ID NO: 564830 - DNA, 22 bp, Homo sapiens
ttttccacttgagaagaggctg

SEQ ID NO: 564831 - DNA, 22 bp, Homo sapiens
tttgtcttccacaggtgtatgg

SEQ ID NO: 564832 - DNA, 22 bp, Homo sapiens
agcgggaatggaaggcagggat

SEQ ID NO: 564833 - DNA, 22 bp, Homo sapiens
tgggagggggaggagggggcca

SEQ ID NO: 564834 - DNA, 22 bp, Homo sapiens
ttccttgtacagactctgcttc

SEQ ID NO: 564835 - DNA, 22 bp, Homo sapiens
tccatacttcacccccctcagt

SEQ ID NO: 564836 - DNA, 22 bp, Homo sapiens
tgaagtagttggtttaggagtt

SEQ ID NO: 564837 - DNA, 22 bp, Homo sapiens
tgtgtctgtgtttcagccccta

SEQ ID NO: 564838 - DNA, 22 bp, Homo sapiens
caaattagctttttaaatagaa

SEQ ID NO: 564839 - DNA, 22 bp, Homo sapiens
ggagggggctaattcttgggta

SEQ ID NO: 564840 - DNA, 22 bp, Homo sapiens
ccaggctcgctccgtcacttcc

SEQ ID NO: 564841 - DNA, 22 bp, Homo sapiens
tgcagattgtgggtgggaggac

SEQ ID NO: 564842 - DNA, 22 bp, Homo sapiens
gggctgacctttcctctggccg

SEQ ID NO: 564843 - DNA, 22 bp, Homo sapiens
ttctttactatgtttcaaagct

SEQ ID NO: 564844 - DNA, 22 bp, Homo sapiens
gacccatacttggtttcagagg

SEQ ID NO: 564845 - DNA, 22 bp, Homo sapiens
tccaattccttccccaccagct

SEQ ID NO: 564846 - DNA, 22 bp, Homo sapiens
ggaatgctgaatgcagctccat

SEQ ID NO: 564847 - DNA, 22 bp, Homo sapiens
tttgcaaggcccgcgccgagcg

SEQ ID NO: 564848 - DNA, 22 bp, Homo sapiens
aggaggcctgcaccttaagtgg

SEQ ID NO: 564849 - DNA, 22 bp, Homo sapiens
tgcaccctggtccgggcagccc

SEQ ID NO: 564850 - DNA, 22 bp, Homo sapiens
caaattcggatctacagggtat

SEQ ID NO: 564851 - DNA, 22 bp, Homo sapiens
tagcagcctcctctcgcgccca

SEQ ID NO: 564852 - DNA, 22 bp, Homo sapiens
tgaaaccccaagagaatccatc

SEQ ID NO: 564853 - DNA, 22 bp, Homo sapiens
gactgttgcagcctcagagcct

SEQ ID NO: 564854 - DNA, 22 bp, Homo sapiens
gatttgtccacataccctctgc

SEQ ID NO: 564855 - DNA, 22 bp, Homo sapiens
ggtgcagagtgggcagctggtt

SEQ ID NO: 564856 - DNA, 22 bp, Homo sapiens
tcggtattgcccatctgcttct

SEQ ID NO: 564857 - DNA, 22 bp, Homo sapiens
tgacccacttctctcctgcttt

SEQ ID NO: 564858 - DNA, 22 bp, Homo sapiens
tctgacaaggtgggttattttt

SEQ ID NO: 564859 - DNA, 22 bp, Homo sapiens
tcagtagagattgtttcaacac

SEQ ID NO: 564860 - DNA, 22 bp, Homo sapiens
ttgactgaaaattaccaggctt

SEQ ID NO: 564861 - DNA, 22 bp, Homo sapiens
tggggaaggcaggcccccgcca

SEQ ID NO: 564862 - DNA, 22 bp, Homo sapiens
tgatctcaattattttcatagc

SEQ ID NO: 564863 - DNA, 22 bp, Homo sapiens
ttattctgaacctcatttttct

SEQ ID NO: 564864 - DNA, 22 bp, Homo sapiens
cggccaacggctgctcgcaggg

SEQ ID NO: 564865 - DNA, 22 bp, Homo sapiens
tcacctttctttatctcttttt

SEQ ID NO: 564866 - DNA, 22 bp, Homo sapiens
tttgtgtggtttgacagctatg

SEQ ID NO: 564867 - DNA, 22 bp, Homo sapiens
gggccgggtgatggaatatgag

SEQ ID NO: 564868 - DNA, 22 bp, Homo sapiens
gggcggggcgcggagcttgacc

SEQ ID NO: 564869 - DNA, 22 bp, Homo sapiens
gctggtcgtttggcagcatagg

SEQ ID NO: 564870 - DNA, 22 bp, Homo sapiens
tagtgccggtgttgtctgggaa

SEQ ID NO: 564871 - DNA, 22 bp, Homo sapiens
tcacatgtgacacatgtgatta

SEQ ID NO: 564872 - DNA, 22 bp, Homo sapiens
ttttccttagcttctctgcgag

SEQ ID NO: 564873 - DNA, 22 bp, Homo sapiens
taaagtctggctttgtaaattt

SEQ ID NO: 564874 - DNA, 22 bp, Homo sapiens
gcctgttaggggctctagcttt

SEQ ID NO: 564875 - DNA, 22 bp, Homo sapiens
tgctgaggggcagagatcagac

SEQ ID NO: 564876 - DNA, 22 bp, Homo sapiens
gatgtaagtgctgaagttctgt

SEQ ID NO: 564877 - DNA, 22 bp, Homo sapiens
acatggcttctgtcttggaaat

SEQ ID NO: 564878 - DNA, 22 bp, Homo sapiens
agcctgggggagcggatcctgc

SEQ ID NO: 564879 - DNA, 22 bp, Homo sapiens
tcctgacccccctggggttgtt

SEQ ID NO: 564880 - DNA, 22 bp, Homo sapiens
atttcattcctgggcagggtct

SEQ ID NO: 564881 - DNA, 22 bp, Homo sapiens
aatcgggccgggagttgggtca

SEQ ID NO: 564882 - DNA, 22 bp, Homo sapiens
gcccagcttcccagcccctcct

SEQ ID NO: 564883 - DNA, 22 bp, Homo sapiens
ggccttgttcccttcccaccca

SEQ ID NO: 564884 - DNA, 22 bp, Homo sapiens
tgagggcaggcttcgcagaaga

SEQ ID NO: 564885 - DNA, 22 bp, Homo sapiens
cctgggactctgaatccagctg

SEQ ID NO: 564886 - DNA, 22 bp, Homo sapiens
tgtgagaccaaagaactacttt

SEQ ID NO: 564887 - DNA, 22 bp, Homo sapiens
gctctgcagggctttggttgtg

SEQ ID NO: 564888 - DNA, 22 bp, Homo sapiens
gcacgcactaagtgtatgccaa

SEQ ID NO: 564889 - DNA, 22 bp, Homo sapiens
cagatagttgctcgggggtcga

SEQ ID NO: 564890 - DNA, 22 bp, Homo sapiens
actgactctggcttcagtgtgg

SEQ ID NO: 564891 - DNA, 22 bp, Homo sapiens
taagctgattccactttttcca

SEQ ID NO: 564892 - DNA, 22 bp, Homo sapiens
gctactttagaaggatgctgta

SEQ ID NO: 564893 - DNA, 22 bp, Homo sapiens
tgtctttttatatgtatgaaat

SEQ ID NO: 564894 - DNA, 22 bp, Homo sapiens
cacgccttctttcttcaaatgc

SEQ ID NO: 564895 - DNA, 22 bp, Homo sapiens
agggcaaaaatcctcatttatt

SEQ ID NO: 564896 - DNA, 22 bp, Homo sapiens
caccagcagggggtccaggcct

SEQ ID NO: 564897 - DNA, 22 bp, Homo sapiens
caaccgtgttcgggaacacttg

SEQ ID NO: 564898 - DNA, 22 bp, Homo sapiens
tttttgttgagcagctgcatga

SEQ ID NO: 564899 - DNA, 22 bp, Homo sapiens
tctgagcagcagccctgcactc

SEQ ID NO: 564900 - DNA, 22 bp, Homo sapiens
aggcagcttttacttatctatg

SEQ ID NO: 564901 - DNA, 22 bp, Homo sapiens
atggggccagggaggggagcca

SEQ ID NO: 564902 - DNA, 22 bp, Homo sapiens
tatctctggtcttacgtaaatt

SEQ ID NO: 564903 - DNA, 22 bp, Homo sapiens
aaatcatgctgacagcattttc

SEQ ID NO: 564904 - DNA, 22 bp, Homo sapiens
tgcatttggctaattttctttt

SEQ ID NO: 564905 - DNA, 22 bp, Homo sapiens
tatcccaagatgtatttggtga

SEQ ID NO: 564906 - DNA, 22 bp, Homo sapiens
ttccaggtagacaggcctgcag

SEQ ID NO: 564907 - DNA, 22 bp, Homo sapiens
tgtgtccctcccagctccttcc

SEQ ID NO: 564908 - DNA, 22 bp, Homo sapiens
gccaagtctccctggtcagaat

SEQ ID NO: 564909 - DNA, 22 bp, Homo sapiens
tgacctgattttgaactgcaac

SEQ ID NO: 564910 - DNA, 22 bp, Homo sapiens
aggagacaatccacgtccctaa

SEQ ID NO: 564911 - DNA, 22 bp, Homo sapiens
agatatgttaatttcagtgctt

SEQ ID NO: 564912 - DNA, 22 bp, Homo sapiens
tgcgttcattttgagtgctgtt

SEQ ID NO: 564913 - DNA, 22 bp, Homo sapiens
tggagctgcattcagcattcct

SEQ ID NO: 564914 - DNA, 22 bp, Homo sapiens
tgtctcaggtggggtggggtgg

SEQ ID NO: 564915 - DNA, 22 bp, Homo sapiens
acctgcccttgggagccgtcag

SEQ ID NO: 564916 - DNA, 22 bp, Homo sapiens
tggaggggaagggagacttggg

SEQ ID NO: 564917 - DNA, 22 bp, Homo sapiens
tttacatctgacattcttgcat

SEQ ID NO: 564918 - DNA, 22 bp, Homo sapiens
ctcagcatcaacctctccttcc

SEQ ID NO: 564919 - DNA, 22 bp, Homo sapiens
aggaaacttgcttcttctaaac

SEQ ID NO: 564920 - DNA, 22 bp, Homo sapiens
ccacaggtgagtgctgctgggg

SEQ ID NO: 564921 - DNA, 22 bp, Homo sapiens
tggagtggggtcaggggagggc

SEQ ID NO: 564922 - DNA, 22 bp, Homo sapiens
cattcaatagatccctaggatg

SEQ ID NO: 564923 - DNA, 22 bp, Homo sapiens
tcagtgcacatggtctacacca

SEQ ID NO: 564924 - DNA, 22 bp, Homo sapiens
taatttctaccagggccatatt

SEQ ID NO: 564925 - DNA, 22 bp, Homo sapiens
tgtaccttgggagttgtagtcc

SEQ ID NO: 564926 - DNA, 22 bp, Homo sapiens
tcctgaacaaactgtgcaataa

SEQ ID NO: 564927 - DNA, 22 bp, Homo sapiens
aaaggaggcagagtagccaagc

SEQ ID NO: 564928 - DNA, 22 bp, Homo sapiens
ggctggccgccccatgccttcc

SEQ ID NO: 564929 - DNA, 22 bp, Homo sapiens
ctcccagatcttcagcatgaac

SEQ ID NO: 564930 - DNA, 22 bp, Homo sapiens
ttcttccagggcctgaatgtcc

SEQ ID NO: 564931 - DNA, 22 bp, Homo sapiens
tgggttctgcaaaatgcagatt

SEQ ID NO: 564932 - DNA, 22 bp, Homo sapiens
tcaggttattggtgggggtaag

SEQ ID NO: 564933 - DNA, 22 bp, Homo sapiens
aaccaggcataggggaaagatt

SEQ ID NO: 564934 - DNA, 22 bp, Homo sapiens
tggagaagactggagagggtat

SEQ ID NO: 564935 - DNA, 22 bp, Homo sapiens
actagggagttagggaaagtgc

SEQ ID NO: 564936 - DNA, 22 bp, Homo sapiens
aaataggcccttttctcaattg

SEQ ID NO: 564937 - DNA, 22 bp, Homo sapiens
tataagtcatgccagccaccag

SEQ ID NO: 564938 - DNA, 22 bp, Homo sapiens
tagggtgataaaaccttctgct

SEQ ID NO: 564939 - DNA, 22 bp, Homo sapiens
attgtttgcactctgccagttt

SEQ ID NO: 564940 - DNA, 22 bp, Homo sapiens
tgggccgcggcgcgcgggctcg

SEQ ID NO: 564941 - DNA, 22 bp, Homo sapiens
tagtctgcagaatgtaagagat

SEQ ID NO: 564942 - DNA, 22 bp, Homo sapiens
gtaagtttcctccaggatccag

SEQ ID NO: 564943 - DNA, 22 bp, Homo sapiens
acaggaggtaagagagtcaatc

SEQ ID NO: 564944 - DNA, 22 bp, Homo sapiens
tctgatccctgtgctcccagtt

SEQ ID NO: 564945 - DNA, 22 bp, Homo sapiens
ttatttgtagcttcccaaagct

SEQ ID NO: 564946 - DNA, 22 bp, Homo sapiens
gtggggatgaggcctgggggtt

SEQ ID NO: 564947 - DNA, 22 bp, Homo sapiens
ttgaaggtgtgtcccaaggtat

SEQ ID NO: 564948 - DNA, 22 bp, Homo sapiens
taaggtatctgccacccctgta

SEQ ID NO: 564949 - DNA, 22 bp, Homo sapiens
gcccttcctcaaggctgactgg

SEQ ID NO: 564950 - DNA, 22 bp, Homo sapiens
tgcacctccaccaacaattcac

SEQ ID NO: 564951 - DNA, 22 bp, Homo sapiens
cctctagatggaagcactgtct

SEQ ID NO: 564952 - DNA, 22 bp, Homo sapiens
cccacctcccactccaggcatc

SEQ ID NO: 564953 - DNA, 22 bp, Homo sapiens
aatggctgggacacactaggca

SEQ ID NO: 564954 - DNA, 22 bp, Homo sapiens
agggtagaccatgtggtagtaa

SEQ ID NO: 564955 - DNA, 22 bp, Homo sapiens
cccattggcatccttgcctgga

SEQ ID NO: 564956 - DNA, 22 bp, Homo sapiens
tacattcttttccctgggtaca

SEQ ID NO: 564957 - DNA, 22 bp, Homo sapiens
taagtgggtgggcatgggaact

SEQ ID NO: 564958 - DNA, 22 bp, Homo sapiens
taggagcagataatggacccac

SEQ ID NO: 564959 - DNA, 22 bp, Homo sapiens
taacacaagtgtatgagctcat

SEQ ID NO: 564960 - DNA, 22 bp, Homo sapiens
cctccaggaggggggtgctgtg

SEQ ID NO: 564961 - DNA, 22 bp, Homo sapiens
tgacagcccgggctgtggcagt

SEQ ID NO: 564962 - DNA, 22 bp, Homo sapiens
gatggttggcgtttgggacttg

SEQ ID NO: 564963 - DNA, 22 bp, Homo sapiens
cacagtgactattctatcagga

SEQ ID NO: 564964 - DNA, 22 bp, Homo sapiens
tttcacttttcagccacctcct

SEQ ID NO: 564965 - DNA, 22 bp, Homo sapiens
ctggcttctgcacacggacggg

SEQ ID NO: 564966 - DNA, 22 bp, Homo sapiens
tttgtgatgcctaagccgtgtt

SEQ ID NO: 564967 - DNA, 22 bp, Homo sapiens
aagccttggctctgctttgctg

SEQ ID NO: 564968 - DNA, 22 bp, Homo sapiens
tggagagagaggccaactgcaa

SEQ ID NO: 564969 - DNA, 22 bp, Homo sapiens
gccgggacggagagggcgaggc

SEQ ID NO: 564970 - DNA, 22 bp, Homo sapiens
acgtcttgcgttccctgcccgc

SEQ ID NO: 564971 - DNA, 22 bp, Homo sapiens
tgtgcaatgatctaggcaagag

SEQ ID NO: 564972 - DNA, 22 bp, Homo sapiens
tgtattctttcaaacttgagaa

SEQ ID NO: 564973 - DNA, 22 bp, Homo sapiens
cccaagagagcgaaggttggca

SEQ ID NO: 564974 - DNA, 22 bp, Homo sapiens
tggcttttcccattgaaggaaa

SEQ ID NO: 564975 - DNA, 22 bp, Homo sapiens
gtgtgaggtgcatgcatgtgag

SEQ ID NO: 564976 - DNA, 22 bp, Homo sapiens
gggacatggccccatggccaag

SEQ ID NO: 564977 - DNA, 22 bp, Homo sapiens
gggagtctcagagagccaagcc

SEQ ID NO: 564978 - DNA, 22 bp, Homo sapiens
tagtaagggcttagcttaatta

SEQ ID NO: 564979 - DNA, 22 bp, Homo sapiens
ttgttgatcagacagcacttct

SEQ ID NO: 564980 - DNA, 22 bp, Homo sapiens
gccaggcctggggatccagggc

SEQ ID NO: 564981 - DNA, 22 bp, Homo sapiens
ttccaggagagagagaggggtg

SEQ ID NO: 564982 - DNA, 22 bp, Homo sapiens
tcttctcgccttttcccctttt

SEQ ID NO: 564983 - DNA, 22 bp, Homo sapiens
atagtaagtgcataataaatgt

SEQ ID NO: 564984 - DNA, 22 bp, Homo sapiens
caggatcaggtgggtagggagc

SEQ ID NO: 564985 - DNA, 22 bp, Homo sapiens
cctgacctgctctggtccactg

SEQ ID NO: 564986 - DNA, 22 bp, Homo sapiens
ccgtcttctcacaggggtctcc

SEQ ID NO: 564987 - DNA, 22 bp, Homo sapiens
ccaggaagcctgagaatgaatc

SEQ ID NO: 564988 - DNA, 22 bp, Homo sapiens
ggtctggtggggttggagaggg

SEQ ID NO: 564989 - DNA, 22 bp, Homo sapiens
tgtaggcgatgccactttgcac

SEQ ID NO: 564990 - DNA, 22 bp, Homo sapiens
caagtccctccctccccattgg

SEQ ID NO: 564991 - DNA, 22 bp, Homo sapiens
tgtctccttgaaagtaacggca

SEQ ID NO: 564992 - DNA, 22 bp, Homo sapiens
tcagaggccatctggggagcag

SEQ ID NO: 564993 - DNA, 22 bp, Homo sapiens
catgaaaagggtgggaggggag

SEQ ID NO: 564994 - DNA, 22 bp, Homo sapiens
ctcggggaggagctgaacacgg

SEQ ID NO: 564995 - DNA, 22 bp, Homo sapiens
gagtaataaatagctgttgaat

SEQ ID NO: 564996 - DNA, 22 bp, Homo sapiens
atgcacctgggcaaggattctg

SEQ ID NO: 564997 - DNA, 22 bp, Homo sapiens
gctggactttgcaccacttcac

SEQ ID NO: 564998 - DNA, 22 bp, Homo sapiens
aaagcagctttgcgtgcagaac

SEQ ID NO: 564999 - DNA, 22 bp, Homo sapiens
caggacccaggggcctggtgac

SEQ ID NO: 565000 - DNA, 22 bp, Homo sapiens
tttaatgaaatatggatttata

SEQ ID NO: 565001 - DNA, 22 bp, Homo sapiens
tgctttggattttgtacctggg

SEQ ID NO: 565002 - DNA, 22 bp, Homo sapiens
tcattcatttagcagacacttt

SEQ ID NO: 565003 - DNA, 22 bp, Homo sapiens
tggttacgaaaggagtctgagc

SEQ ID NO: 565004 - DNA, 22 bp, Homo sapiens
acctcctgtgtgcatggattac

SEQ ID NO: 565005 - DNA, 22 bp, Homo sapiens
gcaggtggggaggagaagggga

SEQ ID NO: 565006 - DNA, 22 bp, Homo sapiens
ggaggatgccttccctgaagcc

SEQ ID NO: 565007 - DNA, 22 bp, Homo sapiens
actgtgctctctagataggcat

SEQ ID NO: 565008 - DNA, 22 bp, Homo sapiens
tgaggctttcagccaagtagta

SEQ ID NO: 565009 - DNA, 22 bp, Homo sapiens
gcgatgcttccctgggtcctat

SEQ ID NO: 565010 - DNA, 22 bp, Homo sapiens
ttggtccttctgaagcttcttc

SEQ ID NO: 565011 - DNA, 22 bp, Homo sapiens
tcagggatcctacttaacttct

SEQ ID NO: 565012 - DNA, 22 bp, Homo sapiens
aggctgcctgtcactttgggta

SEQ ID NO: 565013 - DNA, 22 bp, Homo sapiens
taatgcatcttccccctcagac

SEQ ID NO: 565014 - DNA, 22 bp, Homo sapiens
cattagactgccaggaagggcc

SEQ ID NO: 565015 - DNA, 22 bp, Homo sapiens
tgctcccaggatgcaatgcgcc

SEQ ID NO: 565016 - DNA, 22 bp, Homo sapiens
tgtgctgacaagaccacgtggg

SEQ ID NO: 565017 - DNA, 22 bp, Homo sapiens
aaggctctgcacagcccccaga

SEQ ID NO: 565018 - DNA, 22 bp, Homo sapiens
ttgagagatgccaactaggggt

SEQ ID NO: 565019 - DNA, 22 bp, Homo sapiens
agatggagccagggccctaacc

SEQ ID NO: 565020 - DNA, 22 bp, Homo sapiens
gcgagcgcaggcgcgggcggcg

SEQ ID NO: 565021 - DNA, 22 bp, Homo sapiens
tcttccagctcttctaatggta

SEQ ID NO: 565022 - DNA, 22 bp, Homo sapiens
tcataacgaaatgagagactga

SEQ ID NO: 565023 - DNA, 22 bp, Homo sapiens
tctccaggctcaagacacaggc

SEQ ID NO: 565024 - DNA, 22 bp, Homo sapiens
gggaagagtgggaggtgaacag

SEQ ID NO: 565025 - DNA, 22 bp, Homo sapiens
tcagtcaagtggacagaaatac

SEQ ID NO: 565026 - DNA, 22 bp, Homo sapiens
taacaccagacctttcaggccc

SEQ ID NO: 565027 - DNA, 22 bp, Homo sapiens
aagttgtcaagttttgctacca

SEQ ID NO: 565028 - DNA, 22 bp, Homo sapiens
ttggggctttaacgtgtaagct

SEQ ID NO: 565029 - DNA, 22 bp, Homo sapiens
ctctgcgtcctgtggctgagtg

SEQ ID NO: 565030 - DNA, 22 bp, Homo sapiens
tttgtgaagtgccaattttatg

SEQ ID NO: 565031 - DNA, 22 bp, Homo sapiens
taactgatgaactctggctgtc

SEQ ID NO: 565032 - DNA, 22 bp, Homo sapiens
ccatcttctaggcagagggaca

SEQ ID NO: 565033 - DNA, 22 bp, Homo sapiens
ttccacccaatctcattgcctt

SEQ ID NO: 565034 - DNA, 22 bp, Homo sapiens
aatcaagactcaataaaaattg

SEQ ID NO: 565035 - DNA, 22 bp, Homo sapiens
tatacacattttatctctcctc

SEQ ID NO: 565036 - DNA, 22 bp, Homo sapiens
tctttattgcaaggtgggtaat

SEQ ID NO: 565037 - DNA, 22 bp, Homo sapiens
cccaaggtcaaatgggctggtc

SEQ ID NO: 565038 - DNA, 22 bp, Homo sapiens
ttcttctcttgttcccccaggg

SEQ ID NO: 565039 - DNA, 22 bp, Homo sapiens
tctcaggcctcagcctgccagg

SEQ ID NO: 565040 - DNA, 22 bp, Homo sapiens
gagatttagctgcttaactcct

SEQ ID NO: 565041 - DNA, 22 bp, Homo sapiens
aggccggctaccacttggggct

SEQ ID NO: 565042 - DNA, 22 bp, Homo sapiens
tgtgaattcctcattgttaatt

SEQ ID NO: 565043 - DNA, 22 bp, Homo sapiens
ggggcagctctggccagaggca

SEQ ID NO: 565044 - DNA, 22 bp, Homo sapiens
ggagccaggcgtaggacagggc

SEQ ID NO: 565045 - DNA, 22 bp, Homo sapiens
gtgacagcctgggggactgggc

SEQ ID NO: 565046 - DNA, 22 bp, Homo sapiens
aggctgatgagtttggtttttg

SEQ ID NO: 565047 - DNA, 22 bp, Homo sapiens
taatcacatgtgtcacatgtga

SEQ ID NO: 565048 - DNA, 22 bp, Homo sapiens
aacagaaaagtggcatattgca

SEQ ID NO: 565049 - DNA, 22 bp, Homo sapiens
ggatcctctgagaaccctcctt

SEQ ID NO: 565050 - DNA, 22 bp, Homo sapiens
ccaggttctcagtcagctgggg

SEQ ID NO: 565051 - DNA, 22 bp, Homo sapiens
aatatgtaatgtaatcagtcag

SEQ ID NO: 565052 - DNA, 22 bp, Homo sapiens
ggcggcacgctcctggtgctcc

SEQ ID NO: 565053 - DNA, 22 bp, Homo sapiens
gaggaaagtagtatgggatgat

SEQ ID NO: 565054 - DNA, 22 bp, Homo sapiens
gataagcagcgtggtttggtgc

SEQ ID NO: 565055 - DNA, 22 bp, Homo sapiens
ttgctttctccctggccaggag

SEQ ID NO: 565056 - DNA, 22 bp, Homo sapiens
acctgtctaggcccagcttttg

SEQ ID NO: 565057 - DNA, 22 bp, Homo sapiens
caggactccccagctgcagtca

SEQ ID NO: 565058 - DNA, 22 bp, Homo sapiens
tcctggggacaagggacaggac

SEQ ID NO: 565059 - DNA, 22 bp, Homo sapiens
tcagagaggagagggtgcgggg

SEQ ID NO: 565060 - DNA, 22 bp, Homo sapiens
tgagttgaaacattggtcacac

SEQ ID NO: 565061 - DNA, 22 bp, Homo sapiens
tgccctcttttcctctgagaac

SEQ ID NO: 565062 - DNA, 22 bp, Homo sapiens
agccattgtcgttcatttgaaa

SEQ ID NO: 565063 - DNA, 22 bp, Homo sapiens
tctccttcctctgccacgactt

SEQ ID NO: 565064 - DNA, 22 bp, Homo sapiens
tcctttcagctgttaaccgacc

SEQ ID NO: 565065 - DNA, 22 bp, Homo sapiens
agggaacagaggaggggccgac

SEQ ID NO: 565066 - DNA, 22 bp, Homo sapiens
ttgttatccattatagcaaaac

SEQ ID NO: 565067 - DNA, 22 bp, Homo sapiens
cacaaatcccagaagtcaccgc

SEQ ID NO: 565068 - DNA, 22 bp, Homo sapiens
tgtagaaagcacgggccccagg

SEQ ID NO: 565069 - DNA, 22 bp, Homo sapiens
tcggtccctcgggccagggcag

SEQ ID NO: 565070 - DNA, 22 bp, Homo sapiens
agccaagttggctgagtgtgaa

SEQ ID NO: 565071 - DNA, 22 bp, Homo sapiens
tcaacagacattaattgggcgc

SEQ ID NO: 565072 - DNA, 22 bp, Homo sapiens
ggcagggcagtgccagacgggg

SEQ ID NO: 565073 - DNA, 22 bp, Homo sapiens
gtcccacagaaaagacaggcaa

SEQ ID NO: 565074 - DNA, 22 bp, Homo sapiens
tgggtcagatgttttaggtctg

SEQ ID NO: 565075 - DNA, 22 bp, Homo sapiens
tctctccttcctcctcagtttt

SEQ ID NO: 565076 - DNA, 22 bp, Homo sapiens
agtcggctcaggctcatgatac

SEQ ID NO: 565077 - DNA, 22 bp, Homo sapiens
taggcctgctgacccagggaga

SEQ ID NO: 565078 - DNA, 22 bp, Homo sapiens
tctgagtagtggtccccagccc

SEQ ID NO: 565079 - DNA, 22 bp, Homo sapiens
gggaggaagtgtgagcagagaa

SEQ ID NO: 565080 - DNA, 22 bp, Homo sapiens
ggtggatgggggtagtgtgtgg

SEQ ID NO: 565081 - DNA, 22 bp, Homo sapiens
acgagggacagaggggggggcg

SEQ ID NO: 565082 - DNA, 22 bp, Homo sapiens
tttgtttctcttctgtagtgct

SEQ ID NO: 565083 - DNA, 22 bp, Homo sapiens
ctgggagaatgttgaacatctt

SEQ ID NO: 565084 - DNA, 22 bp, Homo sapiens
tgggcctgtgccttgtctctgg

SEQ ID NO: 565085 - DNA, 22 bp, Homo sapiens
tgctgttttagattttatttgt

SEQ ID NO: 565086 - DNA, 22 bp, Homo sapiens
gagtttatgaccaactgagtcc

SEQ ID NO: 565087 - DNA, 22 bp, Homo sapiens
tacgtgtcccggcatgccctgc

SEQ ID NO: 565088 - DNA, 22 bp, Homo sapiens
aaccttggtcatgtgaaagggc

SEQ ID NO: 565089 - DNA, 22 bp, Homo sapiens
tcctgtggagcaggggtatggg

SEQ ID NO: 565090 - DNA, 22 bp, Homo sapiens
tttatccccggcacccgggctg

SEQ ID NO: 565091 - DNA, 22 bp, Homo sapiens
caggttactgtaaagatgaaat

SEQ ID NO: 565092 - DNA, 22 bp, Homo sapiens
ttggccaccacacctacccctt

SEQ ID NO: 565093 - DNA, 22 bp, Homo sapiens
aattctagtcagtttgggttaa

SEQ ID NO: 565094 - DNA, 22 bp, Homo sapiens
tactttacgggatcatagactt

SEQ ID NO: 565095 - DNA, 22 bp, Homo sapiens
ttatatgacctgctgctacctt

SEQ ID NO: 565096 - DNA, 22 bp, Homo sapiens
gaatctgttgcctccaggtgtt

SEQ ID NO: 565097 - DNA, 22 bp, Homo sapiens
tgaaggctgaagcagcctgtgg

SEQ ID NO: 565098 - DNA, 22 bp, Homo sapiens
tgggaaatggagatagggtgca

SEQ ID NO: 565099 - DNA, 22 bp, Homo sapiens
tcccacttttatctgatgggga

SEQ ID NO: 565100 - DNA, 22 bp, Homo sapiens
ccaggaacagatgtgggaggct

SEQ ID NO: 565101 - DNA, 22 bp, Homo sapiens
ttttccatctctaactcctatg

SEQ ID NO: 565102 - DNA, 22 bp, Homo sapiens
tgttgccttccccccatctttt

SEQ ID NO: 565103 - DNA, 22 bp, Homo sapiens
tcggccatttccggcgcggcgc

SEQ ID NO: 565104 - DNA, 22 bp, Homo sapiens
tgaaggttgcggcagcttcggg

SEQ ID NO: 565105 - DNA, 22 bp, Homo sapiens
agttttctgagtcctatagtat

SEQ ID NO: 565106 - DNA, 22 bp, Homo sapiens
gcagatggactgttgagagtca

SEQ ID NO: 565107 - DNA, 22 bp, Homo sapiens
tgggaagctatttctgggtcta

SEQ ID NO: 565108 - DNA, 22 bp, Homo sapiens
tggtgggagagaagagaggaat

SEQ ID NO: 565109 - DNA, 22 bp, Homo sapiens
agagctgtttttccaaactatt

SEQ ID NO: 565110 - DNA, 22 bp, Homo sapiens
tacttactgctacctgacttgt

SEQ ID NO: 565111 - DNA, 22 bp, Homo sapiens
tggtccctgtcctcctggacct

SEQ ID NO: 565112 - DNA, 22 bp, Homo sapiens
tgccctgccttccagctctggg

SEQ ID NO: 565113 - DNA, 22 bp, Homo sapiens
acatagttgtcttggtggtaca

SEQ ID NO: 565114 - DNA, 22 bp, Homo sapiens
agttgcacagttgttgggcagt

SEQ ID NO: 565115 - DNA, 22 bp, Homo sapiens
ttttcttcctggaatgctctgg

SEQ ID NO: 565116 - DNA, 22 bp, Homo sapiens
cctgacacccttctttcctgtg

SEQ ID NO: 565117 - DNA, 22 bp, Homo sapiens
ttaattttatctatttatgaat

SEQ ID NO: 565118 - DNA, 22 bp, Homo sapiens
cacggtgtttcacggtttaagt

SEQ ID NO: 565119 - DNA, 22 bp, Homo sapiens
ttattacttagaagcatgtaag

SEQ ID NO: 565120 - DNA, 22 bp, Homo sapiens
caaaccagatttggctccaagt

SEQ ID NO: 565121 - DNA, 22 bp, Homo sapiens
ctgtgtgtcagcccaagggcct

SEQ ID NO: 565122 - DNA, 22 bp, Homo sapiens
tcaaataaacagatgaatattt

SEQ ID NO: 565123 - DNA, 22 bp, Homo sapiens
ttagttttctcatttctacaat

SEQ ID NO: 565124 - DNA, 22 bp, Homo sapiens
tgggaatgcctactggttacct

SEQ ID NO: 565125 - DNA, 22 bp, Homo sapiens
ggatttgtccctgtaccccctg

SEQ ID NO: 565126 - DNA, 22 bp, Homo sapiens
gggcacagcagtgagcagaaaa

SEQ ID NO: 565127 - DNA, 22 bp, Homo sapiens
ttctttgagtctacactatgta

SEQ ID NO: 565128 - DNA, 22 bp, Homo sapiens
acaggttgcttattaaaaatgc

SEQ ID NO: 565129 - DNA, 22 bp, Homo sapiens
tctgcttccagctctctgtaag

SEQ ID NO: 565130 - DNA, 22 bp, Homo sapiens
taaggatgcaatcaggcctcct

SEQ ID NO: 565131 - DNA, 22 bp, Homo sapiens
gaaatgcctctggcctggtaaa

SEQ ID NO: 565132 - DNA, 22 bp, Homo sapiens
ttctttgtttctaggtgagagt

SEQ ID NO: 565133 - DNA, 22 bp, Homo sapiens
aaagaagcctacagaagaatga

SEQ ID NO: 565134 - DNA, 22 bp, Homo sapiens
gggtgggagctgagatggctgg

SEQ ID NO: 565135 - DNA, 22 bp, Homo sapiens
cttttgtgggcctcagtttctg

SEQ ID NO: 565136 - DNA, 22 bp, Homo sapiens
agatacaagaggcctgacgtgt

SEQ ID NO: 565137 - DNA, 22 bp, Homo sapiens
tcatcatcctccgagggttagg

SEQ ID NO: 565138 - DNA, 22 bp, Homo sapiens
tctctgcccacagtttcattcc

SEQ ID NO: 565139 - DNA, 22 bp, Homo sapiens
tactgttctcaggtttcatgcc

SEQ ID NO: 565140 - DNA, 22 bp, Homo sapiens
cctgacagatgagggagtattc

SEQ ID NO: 565141 - DNA, 22 bp, Homo sapiens
ccttttctctatgggtaaggca

SEQ ID NO: 565142 - DNA, 22 bp, Homo sapiens
ttattaagagctaatggcaggt

SEQ ID NO: 565143 - DNA, 22 bp, Homo sapiens
tagctttgtacctcagttccct

SEQ ID NO: 565144 - DNA, 22 bp, Homo sapiens
tcagcaggccttagtgattata

SEQ ID NO: 565145 - DNA, 22 bp, Homo sapiens
agggtggggagtggaggtgggg

SEQ ID NO: 565146 - DNA, 22 bp, Homo sapiens
tcagcctgcaattagtgaaatg

SEQ ID NO: 565147 - DNA, 22 bp, Homo sapiens
gggcactgtgacatgtggctcc

SEQ ID NO: 565148 - DNA, 22 bp, Homo sapiens
tagtccatgagcaagatggatt

SEQ ID NO: 565149 - DNA, 22 bp, Homo sapiens
tgctgggggtggggggtagact

SEQ ID NO: 565150 - DNA, 22 bp, Homo sapiens
acaatgccctttctcattgtta

SEQ ID NO: 565151 - DNA, 22 bp, Homo sapiens
ggattcatacagtgatttcatg

SEQ ID NO: 565152 - DNA, 22 bp, Homo sapiens
ggcagccaggcagctggggtaa

SEQ ID NO: 565153 - DNA, 22 bp, Homo sapiens
catctggagaagcatcaaggcc

SEQ ID NO: 565154 - DNA, 22 bp, Homo sapiens
ccttttccctttctcctcacta

SEQ ID NO: 565155 - DNA, 22 bp, Homo sapiens
agcatagaagagagagggggcc

SEQ ID NO: 565156 - DNA, 22 bp, Homo sapiens
agtgtactgtatattttaggca

SEQ ID NO: 565157 - DNA, 22 bp, Homo sapiens
tctgcctgccgcttgcagctcc

SEQ ID NO: 565158 - DNA, 22 bp, Homo sapiens
cctcctgagcacagtcctgggg

SEQ ID NO: 565159 - DNA, 22 bp, Homo sapiens
agtgttctgagcctttctcttt

SEQ ID NO: 565160 - DNA, 22 bp, Homo sapiens
taaggagatggtttgcaacttg

SEQ ID NO: 565161 - DNA, 22 bp, Homo sapiens
aaagacatctgaatacatgatg

SEQ ID NO: 565162 - DNA, 22 bp, Homo sapiens
aagaaaatgttctcttctagat

SEQ ID NO: 565163 - DNA, 22 bp, Homo sapiens
tgagaaccacgtctgctctgag

SEQ ID NO: 565164 - DNA, 22 bp, Homo sapiens
tcattacagactttcattcttg

SEQ ID NO: 565165 - DNA, 22 bp, Homo sapiens
agctgtggtggagttgatgagg

SEQ ID NO: 565166 - DNA, 22 bp, Homo sapiens
tgaagaagggggggaagggcgt

SEQ ID NO: 565167 - DNA, 22 bp, Homo sapiens
ggtgagagaacaagaggcccca

SEQ ID NO: 565168 - DNA, 22 bp, Homo sapiens
caccggaggagagaaatcctgt

SEQ ID NO: 565169 - DNA, 22 bp, Homo sapiens
ttctgagaagctgcatctgaat

SEQ ID NO: 565170 - DNA, 22 bp, Homo sapiens
cacaaacctcccactcagttgt

SEQ ID NO: 565171 - DNA, 22 bp, Homo sapiens
gaggtatgggtgagagagaggc

SEQ ID NO: 565172 - DNA, 22 bp, Homo sapiens
agcaccgttgggaggtgagggc

SEQ ID NO: 565173 - DNA, 22 bp, Homo sapiens
tctggggatggggctggtgagg

SEQ ID NO: 565174 - DNA, 22 bp, Homo sapiens
tgggccctgtctggtggtggct

SEQ ID NO: 565175 - DNA, 22 bp, Homo sapiens
tgccatggggactagtgaagcc

SEQ ID NO: 565176 - DNA, 22 bp, Homo sapiens
tcttctccttttctcttgagtt

SEQ ID NO: 565177 - DNA, 22 bp, Homo sapiens
ctgctggccacttgagcccgct

SEQ ID NO: 565178 - DNA, 22 bp, Homo sapiens
tggtgtgctagagtactcgaag

SEQ ID NO: 565179 - DNA, 22 bp, Homo sapiens
agatggaatttggagactacag

SEQ ID NO: 565180 - DNA, 22 bp, Homo sapiens
tcagcaatttaggaagccatgc

SEQ ID NO: 565181 - DNA, 22 bp, Homo sapiens
gaaattaatattgctcacttgc

SEQ ID NO: 565182 - DNA, 22 bp, Homo sapiens
taggcgggctggggtcggaggt

SEQ ID NO: 565183 - DNA, 22 bp, Homo sapiens
gggaatgggcagatgagaattt

SEQ ID NO: 565184 - DNA, 22 bp, Homo sapiens
atgggcatgagactccacgtga

SEQ ID NO: 565185 - DNA, 22 bp, Homo sapiens
ttcaagccatggctcaggacag

SEQ ID NO: 565186 - DNA, 22 bp, Homo sapiens
ccggcggtcggcgacttctgct

SEQ ID NO: 565187 - DNA, 22 bp, Homo sapiens
tcagggggatataggagagaac

SEQ ID NO: 565188 - DNA, 22 bp, Homo sapiens
aaaaaaaatacaagctgccata

SEQ ID NO: 565189 - DNA, 22 bp, Homo sapiens
gatttccatgcatcacctcatt

SEQ ID NO: 565190 - DNA, 22 bp, Homo sapiens
tgccctggtgaaggccagggtc

SEQ ID NO: 565191 - DNA, 22 bp, Homo sapiens
tacactaaaaccccccaactca

SEQ ID NO: 565192 - DNA, 22 bp, Homo sapiens
taaatagaggtttaattaacac

SEQ ID NO: 565193 - DNA, 22 bp, Homo sapiens
ttttccaagatgtaactacgga

SEQ ID NO: 565194 - DNA, 22 bp, Homo sapiens
tatgcaaaatggataattgcat

SEQ ID NO: 565195 - DNA, 22 bp, Homo sapiens
gccattctcttgcctgcctctc

SEQ ID NO: 565196 - DNA, 22 bp, Homo sapiens
atttgcagagcgtgcttatcat

SEQ ID NO: 565197 - DNA, 22 bp, Homo sapiens
attcaagctttggatgagcagt

SEQ ID NO: 565198 - DNA, 22 bp, Homo sapiens
agatggcgtatagactggctca

SEQ ID NO: 565199 - DNA, 22 bp, Homo sapiens
tcacctccctgagccatgctgc

SEQ ID NO: 565200 - DNA, 22 bp, Homo sapiens
tgcctaggaattatttataatg

SEQ ID NO: 565201 - DNA, 22 bp, Homo sapiens
taatttcctctggcagagggag

SEQ ID NO: 565202 - DNA, 22 bp, Homo sapiens
tatgacatatttgccagcggct

SEQ ID NO: 565203 - DNA, 22 bp, Homo sapiens
agttccatctgtctcatctgct

SEQ ID NO: 565204 - DNA, 22 bp, Homo sapiens
tggcagagggcagggccaggat

SEQ ID NO: 565205 - DNA, 22 bp, Homo sapiens
taatggaggaggtaataagatg

SEQ ID NO: 565206 - DNA, 22 bp, Homo sapiens
atttggaccaaaatagccaaca

SEQ ID NO: 565207 - DNA, 22 bp, Homo sapiens
gtcaccataacacgaagctctg

SEQ ID NO: 565208 - DNA, 22 bp, Homo sapiens
ttctgagatcctgcacatgtgg

SEQ ID NO: 565209 - DNA, 22 bp, Homo sapiens
tcacaaccttgctgttcctgtc

SEQ ID NO: 565210 - DNA, 22 bp, Homo sapiens
taggaggtctaaccggctgctg

SEQ ID NO: 565211 - DNA, 22 bp, Homo sapiens
tgtgaagtagaaatacacttct

SEQ ID NO: 565212 - DNA, 22 bp, Homo sapiens
gctgcccctcactctgccctcc

SEQ ID NO: 565213 - DNA, 22 bp, Homo sapiens
gttttctactttcctacattgc

SEQ ID NO: 565214 - DNA, 22 bp, Homo sapiens
taggggagagaagtgatattct

SEQ ID NO: 565215 - DNA, 22 bp, Homo sapiens
tgagatttggcggtttacctga

SEQ ID NO: 565216 - DNA, 22 bp, Homo sapiens
ttccacatttgctaggctgtat

SEQ ID NO: 565217 - DNA, 22 bp, Homo sapiens
tctcaacttgggggagggggcg

SEQ ID NO: 565218 - DNA, 22 bp, Homo sapiens
tgagtgtcctcgcccttccttt

SEQ ID NO: 565219 - DNA, 22 bp, Homo sapiens
gtttccccagcctagaggtatg

SEQ ID NO: 565220 - DNA, 22 bp, Homo sapiens
tgcttagaaagctgtcgtcggg

SEQ ID NO: 565221 - DNA, 22 bp, Homo sapiens
ctagcacttgctgagtttcttc

SEQ ID NO: 565222 - DNA, 22 bp, Homo sapiens
catcttgcttgttagaggtgct

SEQ ID NO: 565223 - DNA, 22 bp, Homo sapiens
ggtcctccccaggctgtcctcc

SEQ ID NO: 565224 - DNA, 22 bp, Homo sapiens
gccctgctccctccattccccg

SEQ ID NO: 565225 - DNA, 22 bp, Homo sapiens
gcctgaaaggtctggtgttaag

SEQ ID NO: 565226 - DNA, 22 bp, Homo sapiens
tgctatgttttgcctagaactt

SEQ ID NO: 565227 - DNA, 22 bp, Homo sapiens
caggccaactggctgatctcaa

SEQ ID NO: 565228 - DNA, 22 bp, Homo sapiens
tgagagctgtcaatagatctgc

SEQ ID NO: 565229 - DNA, 22 bp, Homo sapiens
aaatttctgcctggaatccctg

SEQ ID NO: 565230 - DNA, 22 bp, Homo sapiens
gcgtgtattgtgtgtttatata

SEQ ID NO: 565231 - DNA, 22 bp, Homo sapiens
aggcgtcctgaggcatccacaa

SEQ ID NO: 565232 - DNA, 22 bp, Homo sapiens
tacttgttaaactgccttggca

SEQ ID NO: 565233 - DNA, 22 bp, Homo sapiens
tttccccaaggtgtggtgtggt

SEQ ID NO: 565234 - DNA, 22 bp, Homo sapiens
catatccccggattttctagtg

SEQ ID NO: 565235 - DNA, 22 bp, Homo sapiens
ttgttccagcactgacaccatc

SEQ ID NO: 565236 - DNA, 22 bp, Homo sapiens
tggttgtggggaaaatgagatg

SEQ ID NO: 565237 - DNA, 22 bp, Homo sapiens
gatgccaaaagtgccccccata

SEQ ID NO: 565238 - DNA, 22 bp, Homo sapiens
caccccagcacatttgacaagc

SEQ ID NO: 565239 - DNA, 22 bp, Homo sapiens
tctatctccccactttattttt

SEQ ID NO: 565240 - DNA, 22 bp, Homo sapiens
gctggaactcaagtgaacgctt

SEQ ID NO: 565241 - DNA, 22 bp, Homo sapiens
agttgcagatagtaagtaagtt

SEQ ID NO: 565242 - DNA, 22 bp, Homo sapiens
tgctgtggtaagctctacactt

SEQ ID NO: 565243 - DNA, 22 bp, Homo sapiens
tcttccttctcagggctttgtt

SEQ ID NO: 565244 - DNA, 22 bp, Homo sapiens
tcttctggtctaaggtcttctg

SEQ ID NO: 565245 - DNA, 22 bp, Homo sapiens
ttcccacgggtcaggggctgag

SEQ ID NO: 565246 - DNA, 22 bp, Homo sapiens
ttatggtcaaaaggcataggtg

SEQ ID NO: 565247 - DNA, 21 bp, Homo sapiens
tacccctgcctcagccttcct

SEQ ID NO: 565248 - DNA, 21 bp, Homo sapiens
tgtatgacagcagccagctct

SEQ ID NO: 565249 - DNA, 21 bp, Homo sapiens
gtgaatacaatgagtgggctg

SEQ ID NO: 565250 - DNA, 21 bp, Homo sapiens
ctccagagggaagtactttct

SEQ ID NO: 565251 - DNA, 21 bp, Homo sapiens
ggagttagtctgctaaatccc

SEQ ID NO: 565252 - DNA, 21 bp, Homo sapiens
acacccatatctcaccatgac

SEQ ID NO: 565253 - DNA, 21 bp, Homo sapiens
ggatgaagagggtgggtggga

SEQ ID NO: 565254 - DNA, 21 bp, Homo sapiens
cctgcatgggagtgggggggt

SEQ ID NO: 565255 - DNA, 21 bp, Homo sapiens
gaaggcgcttccctttggagt

SEQ ID NO: 565256 - DNA, 21 bp, Homo sapiens
ttccagtcttatctacttatc

SEQ ID NO: 565257 - DNA, 21 bp, Homo sapiens
caggagtgggggaggggagag

SEQ ID NO: 565258 - DNA, 21 bp, Homo sapiens
ctccagagggatgcactttct

SEQ ID NO: 565259 - DNA, 21 bp, Homo sapiens
tagtgctgaggcagtatggga

SEQ ID NO: 565260 - DNA, 21 bp, Homo sapiens
tctgccccccgctcgccccgc

SEQ ID NO: 565261 - DNA, 21 bp, Homo sapiens
aatcctttgtccctgggtgag

SEQ ID NO: 565262 - DNA, 21 bp, Homo sapiens
tggtgacccctgtctgttccc

SEQ ID NO: 565263 - DNA, 21 bp, Homo sapiens
ccgtagagattctacagtctg

SEQ ID NO: 565264 - DNA, 21 bp, Homo sapiens
ttgaaaggctatttcttggtc

SEQ ID NO: 565265 - DNA, 21 bp, Homo sapiens
tgccccagattcccgctcctc

SEQ ID NO: 565266 - DNA, 21 bp, Homo sapiens
ggaccataattgcaattaaaa

SEQ ID NO: 565267 - DNA, 21 bp, Homo sapiens
tgggcaccttattgttttccc

SEQ ID NO: 565268 - DNA, 21 bp, Homo sapiens
aacaacaggggaggaaagccc

SEQ ID NO: 565269 - DNA, 21 bp, Homo sapiens
tgttgcagctggagcacagtc

SEQ ID NO: 565270 - DNA, 21 bp, Homo sapiens
catgtccactgatcatcaacc

SEQ ID NO: 565271 - DNA, 21 bp, Homo sapiens
ggttggcgggcgggggagggg

SEQ ID NO: 565272 - DNA, 21 bp, Homo sapiens
caagtgtgatccccaaggacc

SEQ ID NO: 565273 - DNA, 21 bp, Homo sapiens
tctgggggagccagggctggg

SEQ ID NO: 565274 - DNA, 21 bp, Homo sapiens
ctctggagggaagcactttct

SEQ ID NO: 565275 - DNA, 21 bp, Homo sapiens
ctggatggctcctccatgtct

SEQ ID NO: 565276 - DNA, 21 bp, Homo sapiens
tgtgatcagattttgtgttgt

SEQ ID NO: 565277 - DNA, 21 bp, Homo sapiens
tcggagggacccagaacctac

SEQ ID NO: 565278 - DNA, 21 bp, Homo sapiens
atacagaaggcagactctctc

SEQ ID NO: 565279 - DNA, 21 bp, Homo sapiens
ggcctctgtggccccagctga

SEQ ID NO: 565280 - DNA, 21 bp, Homo sapiens
tagctttctctcctcaggaaa

SEQ ID NO: 565281 - DNA, 21 bp, Homo sapiens
gctctcttccccctccctctt

SEQ ID NO: 565282 - DNA, 21 bp, Homo sapiens
tgcgcatctgggatgtggagg

SEQ ID NO: 565283 - DNA, 21 bp, Homo sapiens
tctgcttctggggctgggcgc

SEQ ID NO: 565284 - DNA, 21 bp, Homo sapiens
ttcctctcaggctttcccact

SEQ ID NO: 565285 - DNA, 21 bp, Homo sapiens
tctttgattccttgagggagg

SEQ ID NO: 565286 - DNA, 21 bp, Homo sapiens
aggcactgttgtaatcacttc

SEQ ID NO: 565287 - DNA, 21 bp, Homo sapiens
tgagccacacccacaagagtg

SEQ ID NO: 565288 - DNA, 21 bp, Homo sapiens
tgcctggaaaggacgtggcgg

SEQ ID NO: 565289 - DNA, 21 bp, Homo sapiens
atcgtgcatccttttagagtg

SEQ ID NO: 565290 - DNA, 21 bp, Homo sapiens
tgttctttggtgtagaaggac

SEQ ID NO: 565291 - DNA, 21 bp, Homo sapiens
taggcagctgggtttgttgct

SEQ ID NO: 565292 - DNA, 21 bp, Homo sapiens
gactgcggtatcttgggggag

SEQ ID NO: 565293 - DNA, 21 bp, Homo sapiens
gcagttgggctgcggagatgt

SEQ ID NO: 565294 - DNA, 21 bp, Homo sapiens
gaaatacttttgtttagtatg

SEQ ID NO: 565295 - DNA, 21 bp, Homo sapiens
atgttcagtaaaagttggtga

SEQ ID NO: 565296 - DNA, 21 bp, Homo sapiens
tcccaccctgccatggccctt

SEQ ID NO: 565297 - DNA, 21 bp, Homo sapiens
aagtaaatgacaccaggcctg

SEQ ID NO: 565298 - DNA, 21 bp, Homo sapiens
agacctgtaatgaaacatggt

SEQ ID NO: 565299 - DNA, 21 bp, Homo sapiens
tccatcctgtgtcaatcagaa

SEQ ID NO: 565300 - DNA, 21 bp, Homo sapiens
tttaatgccctggccagagcc

SEQ ID NO: 565301 - DNA, 21 bp, Homo sapiens
tcaagccagggggcgtttttc

SEQ ID NO: 565302 - DNA, 21 bp, Homo sapiens
gtgctttttcttttggttcct

SEQ ID NO: 565303 - DNA, 21 bp, Homo sapiens
ggtaacagggttttctctctc

SEQ ID NO: 565304 - DNA, 21 bp, Homo sapiens
tgatttgcctaggcaaatgca

SEQ ID NO: 565305 - DNA, 21 bp, Homo sapiens
gagtgccttcttttggagcgt

SEQ ID NO: 565306 - DNA, 21 bp, Homo sapiens
tgagaaccacgtctgctctga

SEQ ID NO: 565307 - DNA, 21 bp, Homo sapiens
tcacttctgccacagatgact

SEQ ID NO: 565308 - DNA, 21 bp, Homo sapiens
cctggagtgccccccatccaa

SEQ ID NO: 565309 - DNA, 21 bp, Homo sapiens
caaagcgcttctctttagagt

SEQ ID NO: 565310 - DNA, 21 bp, Homo sapiens
gagttggcaggtgagatgttc

SEQ ID NO: 565311 - DNA, 21 bp, Homo sapiens
ggagggagctggcttcggctc

SEQ ID NO: 565312 - DNA, 21 bp, Homo sapiens
ccccacccatcccctgcctct

SEQ ID NO: 565313 - DNA, 21 bp, Homo sapiens
caacttcccctcagagttccc

SEQ ID NO: 565314 - DNA, 21 bp, Homo sapiens
gggaagaggaaagaatgaaca

SEQ ID NO: 565315 - DNA, 21 bp, Homo sapiens
tcgcttgccctcgccccaagt

SEQ ID NO: 565316 - DNA, 21 bp, Homo sapiens
ccttaaggggctgcttttctt

SEQ ID NO: 565317 - DNA, 21 bp, Homo sapiens
aagttgtttttgaatgttaac

SEQ ID NO: 565318 - DNA, 21 bp, Homo sapiens
aaagggttcttcaattttctt

SEQ ID NO: 565319 - DNA, 21 bp, Homo sapiens
gtcatacacggctctcctctc

SEQ ID NO: 565320 - DNA, 21 bp, Homo sapiens
accaggcattgtggtctccgc

SEQ ID NO: 565321 - DNA, 21 bp, Homo sapiens
tttcttatctccctttatcct

SEQ ID NO: 565322 - DNA, 21 bp, Homo sapiens
gcgctacgggcatgcgcgtgc

SEQ ID NO: 565323 - DNA, 21 bp, Homo sapiens
tcagggaagaggatctggccc

SEQ ID NO: 565324 - DNA, 21 bp, Homo sapiens
actatgttcttagggaaggag

SEQ ID NO: 565325 - DNA, 21 bp, Homo sapiens
catgggtctttggtatctgat

SEQ ID NO: 565326 - DNA, 21 bp, Homo sapiens
gtgcttctgttaatgatgact

SEQ ID NO: 565327 - DNA, 21 bp, Homo sapiens
tggctgcaggcatatttgcat

SEQ ID NO: 565328 - DNA, 21 bp, Homo sapiens
tttaatgaggctgggggtgga

SEQ ID NO: 565329 - DNA, 21 bp, Homo sapiens
ggtagaggggctggcaaggtc

SEQ ID NO: 565330 - DNA, 21 bp, Homo sapiens
ggatgggggctatagatgggg

SEQ ID NO: 565331 - DNA, 21 bp, Homo sapiens
ttggctcaggctgtttcctca

SEQ ID NO: 565332 - DNA, 21 bp, Homo sapiens
tgtctctcttttttatttcaa

SEQ ID NO: 565333 - DNA, 21 bp, Homo sapiens
tgcatcctattgtccgttagt

SEQ ID NO: 565334 - DNA, 21 bp, Homo sapiens
aaatctattctcctttctcat

SEQ ID NO: 565335 - DNA, 21 bp, Homo sapiens
ttactggctgcaaagacgttt

SEQ ID NO: 565336 - DNA, 21 bp, Homo sapiens
tccttgcacctctaggccaca

SEQ ID NO: 565337 - DNA, 21 bp, Homo sapiens
ctgcaggggtagcccctcttc

SEQ ID NO: 565338 - DNA, 21 bp, Homo sapiens
gtgacatttgtagaggaaaac

SEQ ID NO: 565339 - DNA, 21 bp, Homo sapiens
cgctttttctcagctttcggc

SEQ ID NO: 565340 - DNA, 21 bp, Homo sapiens
tacttgaactgggtcccgggc

SEQ ID NO: 565341 - DNA, 21 bp, Homo sapiens
tagacactgtgtgctggattt

SEQ ID NO: 565342 - DNA, 21 bp, Homo sapiens
tgaatgccaattagccgggct

SEQ ID NO: 565343 - DNA, 21 bp, Homo sapiens
ttttattgatgaatggccact

SEQ ID NO: 565344 - DNA, 21 bp, Homo sapiens
ctacaaagggaagccctttct

SEQ ID NO: 565345 - DNA, 21 bp, Homo sapiens
ggagaggaggagctgagtcac

SEQ ID NO: 565346 - DNA, 21 bp, Homo sapiens
aaagtgcttccttttagaggc

SEQ ID NO: 565347 - DNA, 21 bp, Homo sapiens
cattggccacccctgtgccgc

SEQ ID NO: 565348 - DNA, 21 bp, Homo sapiens
tgtggctggaagcttgtatta

SEQ ID NO: 565349 - DNA, 21 bp, Homo sapiens
agatctagtcctggctcttcc

SEQ ID NO: 565350 - DNA, 21 bp, Homo sapiens
tttgcccattctcttgacact

SEQ ID NO: 565351 - DNA, 21 bp, Homo sapiens
acagtttgcacgtttttcaga

SEQ ID NO: 565352 - DNA, 21 bp, Homo sapiens
ctgcaaagggaagccctttct

SEQ ID NO: 565353 - DNA, 21 bp, Homo sapiens
gtcaacacttgctggtttcct

SEQ ID NO: 565354 - DNA, 21 bp, Homo sapiens
ctactcgctgtatttttttgg

SEQ ID NO: 565355 - DNA, 21 bp, Homo sapiens
tctggcttccttcttggtttc

SEQ ID NO: 565356 - DNA, 21 bp, Homo sapiens
ggtcataggcttccatttctt

SEQ ID NO: 565357 - DNA, 21 bp, Homo sapiens
aatgttgctcggtgaacccct

SEQ ID NO: 565358 - DNA, 21 bp, Homo sapiens
aattgcacggtatccatctgt

SEQ ID NO: 565359 - DNA, 21 bp, Homo sapiens
gagattcatagcagcaatgta

SEQ ID NO: 565360 - DNA, 21 bp, Homo sapiens
agataaataaagatgattacc

SEQ ID NO: 565361 - DNA, 21 bp, Homo sapiens
gtctctatgtcaatggtgagt

SEQ ID NO: 565362 - DNA, 21 bp, Homo sapiens
ctctagagggaagcactttct

SEQ ID NO: 565363 - DNA, 21 bp, Homo sapiens
tccttgtttccttgatctttc

SEQ ID NO: 565364 - DNA, 21 bp, Homo sapiens
gcctatgtgtgtatgaaggga

SEQ ID NO: 565365 - DNA, 21 bp, Homo sapiens
atgagtgctggtgaccaccag

SEQ ID NO: 565366 - DNA, 21 bp, Homo sapiens
agcaatttcagagcgtgcctg

SEQ ID NO: 565367 - DNA, 21 bp, Homo sapiens
actgagggaatgggggatgag

SEQ ID NO: 565368 - DNA, 21 bp, Homo sapiens
tcacttcctgaccctgttgct

SEQ ID NO: 565369 - DNA, 21 bp, Homo sapiens
gctgcgggctgcggtcagggc

SEQ ID NO: 565370 - DNA, 21 bp, Homo sapiens
tggggggtatgagagttggct

SEQ ID NO: 565371 - DNA, 21 bp, Homo sapiens
ctgttcctgagtcttgccagt

SEQ ID NO: 565372 - DNA, 21 bp, Homo sapiens
acctgacactgcaacccattt

SEQ ID NO: 565373 - DNA, 21 bp, Homo sapiens
ttccaagtgccttctgcagct

SEQ ID NO: 565374 - DNA, 21 bp, Homo sapiens
aatataacacagatggcctgt

SEQ ID NO: 565375 - DNA, 21 bp, Homo sapiens
aaagcgcttcccttcagagtg

SEQ ID NO: 565376 - DNA, 21 bp, Homo sapiens
acggtgtgcaatcagctgttg

SEQ ID NO: 565377 - DNA, 21 bp, Homo sapiens
gctggaggcttgtaaagtcgt

SEQ ID NO: 565378 - DNA, 21 bp, Homo sapiens
gtaagtgccagtggcagcagg

SEQ ID NO: 565379 - DNA, 21 bp, Homo sapiens
cccagagtctgtttttttgac

SEQ ID NO: 565380 - DNA, 21 bp, Homo sapiens
gctatggctcgcatctggggg

SEQ ID NO: 565381 - DNA, 21 bp, Homo sapiens
tttatgcacagggggagattc

SEQ ID NO: 565382 - DNA, 21 bp, Homo sapiens
agaccctggtctgcactctat

SEQ ID NO: 565383 - DNA, 21 bp, Homo sapiens
aaagcgcttctctttagagga

SEQ ID NO: 565384 - DNA, 21 bp, Homo sapiens
tctccttcatctctgctttac

SEQ ID NO: 565385 - DNA, 21 bp, Homo sapiens
agttaattggagggagggaga

SEQ ID NO: 565386 - DNA, 21 bp, Homo sapiens
tcccctgatgggaagagcaga

SEQ ID NO: 565387 - DNA, 21 bp, Homo sapiens
aacttgaaaaatgcagatgtt

SEQ ID NO: 565388 - DNA, 21 bp, Homo sapiens
tcaagaggggattaggggctt

SEQ ID NO: 565389 - DNA, 21 bp, Homo sapiens
gtgcaggctgggatgtggcac

SEQ ID NO: 565390 - DNA, 21 bp, Homo sapiens
gtggggctgggggcgggggtg

SEQ ID NO: 565391 - DNA, 21 bp, Homo sapiens
aagtgaaactgagacactgtt

SEQ ID NO: 565392 - DNA, 21 bp, Homo sapiens
ttttgcaccttttggagtgaa

SEQ ID NO: 565393 - DNA, 21 bp, Homo sapiens
tggagctgcctggaccagatg

SEQ ID NO: 565394 - DNA, 21 bp, Homo sapiens
tggggttttggtggcggctgt

SEQ ID NO: 565395 - DNA, 21 bp, Homo sapiens
tgcacagacccctggctctga

SEQ ID NO: 565396 - DNA, 21 bp, Homo sapiens
ggagggcatgcaattcacaga

SEQ ID NO: 565397 - DNA, 21 bp, Homo sapiens
ctcgcgggcctcggacgagcg

SEQ ID NO: 565398 - DNA, 21 bp, Homo sapiens
tgccatttttcttggccccag

SEQ ID NO: 565399 - DNA, 21 bp, Homo sapiens
cttgggaaggggagaagctgt

SEQ ID NO: 565400 - DNA, 21 bp, Homo sapiens
aagcctgtaattagctcaggg

SEQ ID NO: 565401 - DNA, 21 bp, Homo sapiens
atagtcagggccctgtttgat

SEQ ID NO: 565402 - DNA, 21 bp, Homo sapiens
ctcagcctcttttcttcttga

SEQ ID NO: 565403 - DNA, 21 bp, Homo sapiens
aagcttatggagcagaggatt

SEQ ID NO: 565404 - DNA, 21 bp, Homo sapiens
ccagagagacctagcaaccaa

SEQ ID NO: 565405 - DNA, 21 bp, Homo sapiens
tagtttctacccagttaatgg

SEQ ID NO: 565406 - DNA, 21 bp, Homo sapiens
gacgtacgaatctgcattttt

SEQ ID NO: 565407 - DNA, 21 bp, Homo sapiens
gcgtggagttcccctcctttc

SEQ ID NO: 565408 - DNA, 21 bp, Homo sapiens
agaccttaaaatatcaactga

SEQ ID NO: 565409 - DNA, 21 bp, Homo sapiens
ttcctatgcatatacttcttt

SEQ ID NO: 565410 - DNA, 21 bp, Homo sapiens
ttaagacttgcagtgatgttt

SEQ ID NO: 565411 - DNA, 21 bp, Homo sapiens
gtctctatgtcaatggtgagc

SEQ ID NO: 565412 - DNA, 21 bp, Homo sapiens
aaagtgcttcctttttgaggg

SEQ ID NO: 565413 - DNA, 21 bp, Homo sapiens
gagttgggggacgatgggaga

SEQ ID NO: 565414 - DNA, 21 bp, Homo sapiens
ccttccctgttgcatacagta

SEQ ID NO: 565415 - DNA, 21 bp, Homo sapiens
tcatgcagtttcttatctgcc

SEQ ID NO: 565416 - DNA, 21 bp, Homo sapiens
agggcgtttatttccatcttg

SEQ ID NO: 565417 - DNA, 21 bp, Homo sapiens
caggctgcctgcacacaggag

SEQ ID NO: 565418 - DNA, 21 bp, Homo sapiens
tcagtctcatctgcaaagaag

SEQ ID NO: 565419 - DNA, 21 bp, Homo sapiens
gctcacggcttgcccctccct

SEQ ID NO: 565420 - DNA, 21 bp, Homo sapiens
gaaacttggtgagtctggcca

SEQ ID NO: 565421 - DNA, 21 bp, Homo sapiens
tccaagcaggggcagcaagga

SEQ ID NO: 565422 - DNA, 21 bp, Homo sapiens
aagtgtttccaatatggctgg

SEQ ID NO: 565423 - DNA, 21 bp, Homo sapiens
cagaatcggcccctcgcccct

SEQ ID NO: 565424 - DNA, 21 bp, Homo sapiens
taggtaatgggttaagtaggc

SEQ ID NO: 565425 - DNA, 21 bp, Homo sapiens
gtgtggccctggaggtgtgag

SEQ ID NO: 565426 - DNA, 21 bp, Homo sapiens
cttttacagcattgggagggt

SEQ ID NO: 565427 - DNA, 21 bp, Homo sapiens
tgcttcatttctcccagaggt

SEQ ID NO: 565428 - DNA, 21 bp, Homo sapiens
agcaggagacacacaagtccc

SEQ ID NO: 565429 - DNA, 21 bp, Homo sapiens
ttctccaaaagggagcacttt

SEQ ID NO: 565430 - DNA, 21 bp, Homo sapiens
aataattccaggtaggaattt

SEQ ID NO: 565431 - DNA, 21 bp, Homo sapiens
tattgactctcaaatttgcag

SEQ ID NO: 565432 - DNA, 21 bp, Homo sapiens
gggagcatgcagagaggcggc

SEQ ID NO: 565433 - DNA, 21 bp, Homo sapiens
cgagctaggatgggaggaggc

SEQ ID NO: 565434 - DNA, 21 bp, Homo sapiens
taccacttctttgtgtgtgag

SEQ ID NO: 565435 - DNA, 21 bp, Homo sapiens
ttccactttgcttctctgggt

SEQ ID NO: 565436 - DNA, 21 bp, Homo sapiens
tccatgtgtagaggaaagata

SEQ ID NO: 565437 - DNA, 21 bp, Homo sapiens
actctaactggtgctttaggg

SEQ ID NO: 565438 - DNA, 21 bp, Homo sapiens
aaaccgttaccattactgagt

SEQ ID NO: 565439 - DNA, 21 bp, Homo sapiens
gaaggcgcttccctttagagc

SEQ ID NO: 565440 - DNA, 21 bp, Homo sapiens
tcttcacatctacagagttca

SEQ ID NO: 565441 - DNA, 21 bp, Homo sapiens
tccagggcctcggacagggcc

SEQ ID NO: 565442 - DNA, 21 bp, Homo sapiens
ttgcctcatgtcttggcttct

SEQ ID NO: 565443 - DNA, 21 bp, Homo sapiens
gagctatctgctggagttttt

SEQ ID NO: 565444 - DNA, 21 bp, Homo sapiens
tcaacctctttgagcctcagt

SEQ ID NO: 565445 - DNA, 21 bp, Homo sapiens
ctacaaagggaagcactttct

SEQ ID NO: 565446 - DNA, 21 bp, Homo sapiens
caagatctcggcttgcttcct

SEQ ID NO: 565447 - DNA, 21 bp, Homo sapiens
tggcggcggtgccggctggga

SEQ ID NO: 565448 - DNA, 21 bp, Homo sapiens
aaggtttttaggcaggagagc

SEQ ID NO: 565449 - DNA, 21 bp, Homo sapiens
cagtccaggaaggtgtaagag

SEQ ID NO: 565450 - DNA, 21 bp, Homo sapiens
gctggtcttccctttccactg

SEQ ID NO: 565451 - DNA, 21 bp, Homo sapiens
agcgacattgtgttttcttcc

SEQ ID NO: 565452 - DNA, 21 bp, Homo sapiens
gtcctctcccagcctcttgcc

SEQ ID NO: 565453 - DNA, 21 bp, Homo sapiens
ctcagggtctgaggagaccgt

SEQ ID NO: 565454 - DNA, 21 bp, Homo sapiens
caacctggaggactccatgct

SEQ ID NO: 565455 - DNA, 21 bp, Homo sapiens
ctctcagctgctggcacgggc

SEQ ID NO: 565456 - DNA, 21 bp, Homo sapiens
actctaattggcagtgggtag

SEQ ID NO: 565457 - DNA, 21 bp, Homo sapiens
cagcagcacactgtggtttgt

SEQ ID NO: 565458 - DNA, 21 bp, Homo sapiens
tgaaacatacacgggaaacct

SEQ ID NO: 565459 - DNA, 21 bp, Homo sapiens
tgcacttgccagataagtagc

SEQ ID NO: 565460 - DNA, 21 bp, Homo sapiens
cttcttgcctgtcttggtgct

SEQ ID NO: 565461 - DNA, 21 bp, Homo sapiens
tgcctgctaactggggtgcag

SEQ ID NO: 565462 - DNA, 21 bp, Homo sapiens
tgcattcttgtgtaaggtagt

SEQ ID NO: 565463 - DNA, 21 bp, Homo sapiens
gtgtcttttgctctgcagtca

SEQ ID NO: 565464 - DNA, 21 bp, Homo sapiens
cttgccattttcaagtgcagt

SEQ ID NO: 565465 - DNA, 21 bp, Homo sapiens
agtcttcagattagatagtga

SEQ ID NO: 565466 - DNA, 21 bp, Homo sapiens
taccattttgcagtggctggt

SEQ ID NO: 565467 - DNA, 21 bp, Homo sapiens
gtgttggcatcctgtgatgcc

SEQ ID NO: 565468 - DNA, 21 bp, Homo sapiens
tatctccctcctgttttccca

SEQ ID NO: 565469 - DNA, 21 bp, Homo sapiens
tgggggactcagagcctccgc

SEQ ID NO: 565470 - DNA, 21 bp, Homo sapiens
gctgtgggagctgtcgtgtct

SEQ ID NO: 565471 - DNA, 21 bp, Homo sapiens
cccagataatggcactctcaa

SEQ ID NO: 565472 - DNA, 21 bp, Homo sapiens
gggcagcaggagataggaagg

SEQ ID NO: 565473 - DNA, 21 bp, Homo sapiens
tcacccttgtggcagcgaggc

SEQ ID NO: 565474 - DNA, 21 bp, Homo sapiens
aaagcgcttccctttgctgga

SEQ ID NO: 565475 - DNA, 21 bp, Homo sapiens
ttctgtggctggctttgggga

SEQ ID NO: 565476 - DNA, 21 bp, Homo sapiens
tgccctccacctgccctgcct

SEQ ID NO: 565477 - DNA, 21 bp, Homo sapiens
tgacctcacctcttcctctcc

SEQ ID NO: 565478 - DNA, 21 bp, Homo sapiens
gcaatgatgcggatcttgtga

SEQ ID NO: 565479 - DNA, 21 bp, Homo sapiens
gctggcttggatttggagggg

SEQ ID NO: 565480 - DNA, 21 bp, Homo sapiens
gttatttttatgccgcaagcc

SEQ ID NO: 565481 - DNA, 21 bp, Homo sapiens
ctcttgagggaagcactttct

SEQ ID NO: 565482 - DNA, 21 bp, Homo sapiens
gctgttctctagaaatccagc

SEQ ID NO: 565483 - DNA, 21 bp, Homo sapiens
ttccaccctggtcccctgctg

SEQ ID NO: 565484 - DNA, 21 bp, Homo sapiens
tttatggaaatgctctgcagg

SEQ ID NO: 565485 - DNA, 21 bp, Homo sapiens
ctcgtttattcataacaagtg

SEQ ID NO: 565486 - DNA, 21 bp, Homo sapiens
caaagcgcttccctttggagc

SEQ ID NO: 565487 - DNA, 21 bp, Homo sapiens
aaaggggtggagggtgtggtt

SEQ ID NO: 565488 - DNA, 21 bp, Homo sapiens
tggggaagtgtccagagtgat

SEQ ID NO: 565489 - DNA, 21 bp, Homo sapiens
tgagtgtgctagagtcctcga

SEQ ID NO: 565490 - DNA, 21 bp, Homo sapiens
atccttgctatctgggtgcta

SEQ ID NO: 565491 - DNA, 21 bp, Homo sapiens
tttcaagccagggggcgtttt

SEQ ID NO: 565492 - DNA, 21 bp, Homo sapiens
aaaggaaatcaattgtgctcc

SEQ ID NO: 565493 - DNA, 21 bp, Homo sapiens
aaagtgcttctctttggtggg

SEQ ID NO: 565494 - DNA, 21 bp, Homo sapiens
tcaccccccgcccaccctgtg

SEQ ID NO: 565495 - DNA, 21 bp, Homo sapiens
cgaggcccatggtgccgtgcg

SEQ ID NO: 565496 - DNA, 21 bp, Homo sapiens
aagtgcttccttttagagggt

SEQ ID NO: 565497 - DNA, 21 bp, Homo sapiens
tcgatgggatgctgggacctg

SEQ ID NO: 565498 - DNA, 21 bp, Homo sapiens
gctaacattctggttacgtgt

SEQ ID NO: 565499 - DNA, 21 bp, Homo sapiens
acaatgggaggaagtgctagc

SEQ ID NO: 565500 - DNA, 21 bp, Homo sapiens
agagccaaatgagcattaatg

SEQ ID NO: 565501 - DNA, 21 bp, Homo sapiens
tgcagcacaaccaaacagtga

SEQ ID NO: 565502 - DNA, 21 bp, Homo sapiens
acttgcttgctttctgcttgg

SEQ ID NO: 565503 - DNA, 21 bp, Homo sapiens
ccacacacccttcttggaact

SEQ ID NO: 565504 - DNA, 21 bp, Homo sapiens
taatccatagaaatccctgag

SEQ ID NO: 565505 - DNA, 21 bp, Homo sapiens
tggtggagcgcttgttgtagt

SEQ ID NO: 565506 - DNA, 21 bp, Homo sapiens
taatcaatccatttggtggcc

SEQ ID NO: 565507 - DNA, 21 bp, Homo sapiens
tctagagggaagcactttctg

SEQ ID NO: 565508 - DNA, 21 bp, Homo sapiens
gcggctctgccgaaggggggt

SEQ ID NO: 565509 - DNA, 21 bp, Homo sapiens
tacagctcggcagataaagcc

SEQ ID NO: 565510 - DNA, 21 bp, Homo sapiens
tttcttccgccaaattcccca

SEQ ID NO: 565511 - DNA, 21 bp, Homo sapiens
cgctgattggctgccgagacc

SEQ ID NO: 565512 - DNA, 21 bp, Homo sapiens
ggcctcagtttccccacctgc

SEQ ID NO: 565513 - DNA, 21 bp, Homo sapiens
ctctgacccttctctctgatt

SEQ ID NO: 565514 - DNA, 21 bp, Homo sapiens
tttggaagccaatgtgctgat

SEQ ID NO: 565515 - DNA, 21 bp, Homo sapiens
tcaagactgaggctcattgac

SEQ ID NO: 565516 - DNA, 21 bp, Homo sapiens
gggaagctggcctcagctggg

SEQ ID NO: 565517 - DNA, 21 bp, Homo sapiens
ctcagaaaagctaaggagaaa

SEQ ID NO: 565518 - DNA, 21 bp, Homo sapiens
cccgaagccgtgcgcttcttc

SEQ ID NO: 565519 - DNA, 21 bp, Homo sapiens
ggtgtgaatgagacagctgcc

SEQ ID NO: 565520 - DNA, 21 bp, Homo sapiens
aaagtgcttccttttagaggg

SEQ ID NO: 565521 - DNA, 21 bp, Homo sapiens
aaaattgagctgcccaaagag

SEQ ID NO: 565522 - DNA, 21 bp, Homo sapiens
aacacacctggttaacctctt

SEQ ID NO: 565523 - DNA, 20 bp, Homo sapiens
gccagaagttttctattatg

SEQ ID NO: 565524 - DNA, 20 bp, Homo sapiens
caaagcgcttctctttagag

SEQ ID NO: 565525 - DNA, 20 bp, Homo sapiens
tcttggttacgctgtagtgc

SEQ ID NO: 565526 - DNA, 20 bp, Homo sapiens
aggagaaactgtccttttct

SEQ ID NO: 565527 - DNA, 20 bp, Homo sapiens
aaagagcatcccttggttag

SEQ ID NO: 565528 - DNA, 20 bp, Homo sapiens
caagccagaaatagtgctgt

SEQ ID NO: 565529 - DNA, 20 bp, Homo sapiens
tcccctcccccagcccgggc

SEQ ID NO: 565530 - DNA, 20 bp, Homo sapiens
cacatctgtcaaatgttaaa

SEQ ID NO: 565531 - DNA, 20 bp, Homo sapiens
gtgccccttcctgcccagga

SEQ ID NO: 565532 - DNA, 20 bp, Homo sapiens
aaagtgcttctctttggtgg

SEQ ID NO: 565533 - DNA, 20 bp, Homo sapiens
ggaggggtctggagtgggga

SEQ ID NO: 565534 - DNA, 20 bp, Homo sapiens
tggctatatgctggcttcca

SEQ ID NO: 565535 - DNA, 20 bp, Homo sapiens
tgggggagcgggggaggggc

SEQ ID NO: 565536 - DNA, 20 bp, Homo sapiens
tcccagttccaagaaagtgc

SEQ ID NO: 565537 - DNA, 20 bp, Homo sapiens
actgtggtgaagcgccaggc

SEQ ID NO: 565538 - DNA, 20 bp, Homo sapiens
aacgcgcttccctatagagg

SEQ ID NO: 565539 - DNA, 20 bp, Homo sapiens
gggcatgattgcaattaaaa

SEQ ID NO: 565540 - DNA, 20 bp, Homo sapiens
ttgtggtgaaagggggcaaa

SEQ ID NO: 565541 - DNA, 20 bp, Homo sapiens
cttttcctgcagctcaagga

SEQ ID NO: 565542 - DNA, 20 bp, Homo sapiens
tcatgcatttgatccatgga

SEQ ID NO: 565543 - DNA, 20 bp, Homo sapiens
acaggggagggccaggccct

SEQ ID NO: 565544 - DNA, 20 bp, Homo sapiens
cattactttcaatgggactc

SEQ ID NO: 565545 - DNA, 20 bp, Homo sapiens
ggtgttagtcctaacaatta

SEQ ID NO: 565546 - DNA, 20 bp, Homo sapiens
ggctggattggggagaggga

SEQ ID NO: 565547 - DNA, 20 bp, Homo sapiens
ggtggccaggccccacaggg

SEQ ID NO: 565548 - DNA, 20 bp, Homo sapiens
cagtgaagggaacagggagc

SEQ ID NO: 565549 - DNA, 20 bp, Homo sapiens
attgatgagctgcctgcggc

SEQ ID NO: 565550 - DNA, 20 bp, Homo sapiens
tctccttggtgggcccaagg

SEQ ID NO: 565551 - DNA, 20 bp, Homo sapiens
tgtgtattttgtatttgagt

SEQ ID NO: 565552 - DNA, 20 bp, Homo sapiens
cttctggtcccttctagttc

SEQ ID NO: 565553 - DNA, 20 bp, Homo sapiens
atttgtgtgtgcacggggca

SEQ ID NO: 565554 - DNA, 20 bp, Homo sapiens
tagaccttctattttctctc

SEQ ID NO: 565555 - DNA, 20 bp, Homo sapiens
attaggcctggcggtctgag

SEQ ID NO: 565556 - DNA, 20 bp, Homo sapiens
ggcactttggggaagctgct

SEQ ID NO: 565557 - DNA, 20 bp, Homo sapiens
ctggggtcggagcgtcgggc

SEQ ID NO: 565558 - DNA, 20 bp, Homo sapiens
tcagggctcacagtgcctaa

SEQ ID NO: 565559 - DNA, 20 bp, Homo sapiens
gaggggtggggtgaggatgg

SEQ ID NO: 565560 - DNA, 20 bp, Homo sapiens
aaggctacctgggaagagct

SEQ ID NO: 565561 - DNA, 20 bp, Homo sapiens
ggtggaagcttggctgaggt

SEQ ID NO: 565562 - DNA, 20 bp, Homo sapiens
tcagtggaaatgaggcctgc

SEQ ID NO: 565563 - DNA, 20 bp, Homo sapiens
cctctgctagtgcttgagct

SEQ ID NO: 565564 - DNA, 20 bp, Homo sapiens
ctccagagggaagtactttc

SEQ ID NO: 565565 - DNA, 20 bp, Homo sapiens
aagtgcttccttttagaggg

SEQ ID NO: 565566 - DNA, 20 bp, Homo sapiens
tacagcctgtggggaagtgt

SEQ ID NO: 565567 - DNA, 20 bp, Homo sapiens
atcgtgcatccctttagagt

SEQ ID NO: 565568 - DNA, 20 bp, Homo sapiens
gtggactccatggtgaagag

SEQ ID NO: 565569 - DNA, 20 bp, Homo sapiens
ctaaaggcttcagggtgtta

SEQ ID NO: 565570 - DNA, 20 bp, Homo sapiens
gacagaagcagctgggagga

SEQ ID NO: 565571 - DNA, 20 bp, Homo sapiens
cactttcaagggggcctggt

SEQ ID NO: 565572 - DNA, 20 bp, Homo sapiens
agcagcctggggaggagggc

SEQ ID NO: 565573 - DNA, 20 bp, Homo sapiens
caggaaggctagaagcagga

SEQ ID NO: 565574 - DNA, 20 bp, Homo sapiens
gtctctcaggtaaatatgaa

SEQ ID NO: 565575 - DNA, 20 bp, Homo sapiens
atcccgtccgcccctttcag

SEQ ID NO: 565576 - DNA, 20 bp, Homo sapiens
tccaactgcaagaagttact

SEQ ID NO: 565577 - DNA, 20 bp, Homo sapiens
agctcaccaaggccctgcgc

SEQ ID NO: 565578 - DNA, 20 bp, Homo sapiens
gtcgtgctggatcgtcccgt

SEQ ID NO: 565579 - DNA, 20 bp, Homo sapiens
gaagcgcggggaggggcagg

SEQ ID NO: 565580 - DNA, 20 bp, Homo sapiens
tgatcttttcttgctgcccc

SEQ ID NO: 565581 - DNA, 20 bp, Homo sapiens
taatgcccctaaaaatcctt

SEQ ID NO: 565582 - DNA, 20 bp, Homo sapiens
cttttaaagctactttaaaa

SEQ ID NO: 565583 - DNA, 20 bp, Homo sapiens
tcagtggacatgaagctacc

SEQ ID NO: 565584 - DNA, 20 bp, Homo sapiens
ttctctgaagccataaatca

SEQ ID NO: 565585 - DNA, 20 bp, Homo sapiens
tttagtctctgtccagcctg

SEQ ID NO: 565586 - DNA, 20 bp, Homo sapiens
ggacgagcatatctgccagg

SEQ ID NO: 565587 - DNA, 20 bp, Homo sapiens
ctgggcctgggcagggaagg

SEQ ID NO: 565588 - DNA, 20 bp, Homo sapiens
ggatgctgatcagctcactt

SEQ ID NO: 565589 - DNA, 20 bp, Homo sapiens
tgctgtctcaacatttacta

SEQ ID NO: 565590 - DNA, 20 bp, Homo sapiens
tctgcaaagggaagcccttt

SEQ ID NO: 565591 - DNA, 20 bp, Homo sapiens
gcagatcagggaagagtggg

SEQ ID NO: 565592 - DNA, 20 bp, Homo sapiens
tccttacattttgtatttct

SEQ ID NO: 565593 - DNA, 20 bp, Homo sapiens
acagaagctagcaggaaagt

SEQ ID NO: 565594 - DNA, 20 bp, Homo sapiens
tgattgaaacctctacgagt

SEQ ID NO: 565595 - DNA, 20 bp, Homo sapiens
ccagagggggagggggctgc

SEQ ID NO: 565596 - DNA, 20 bp, Homo sapiens
ttagctgttccattcatcag

SEQ ID NO: 565597 - DNA, 20 bp, Homo sapiens
tcaggggttgagaggttaga

SEQ ID NO: 565598 - DNA, 20 bp, Homo sapiens
tgggctctgtctctaactgc

SEQ ID NO: 565599 - DNA, 20 bp, Homo sapiens
gggggatggatagacagaca

SEQ ID NO: 565600 - DNA, 20 bp, Homo sapiens
gttttctattgattggtgac

SEQ ID NO: 565601 - DNA, 20 bp, Homo sapiens
acattcacaggacagaagga

SEQ ID NO: 565602 - DNA, 20 bp, Homo sapiens
ggcctcccggagctgctccc

SEQ ID NO: 565603 - DNA, 20 bp, Homo sapiens
gggcagcagaagataggaag

SEQ ID NO: 565604 - DNA, 20 bp, Homo sapiens
ctggatggctcctccatgtc

SEQ ID NO: 565605 - DNA, 20 bp, Homo sapiens
tgcaggtgttgcagaaagat

SEQ ID NO: 565606 - DNA, 20 bp, Homo sapiens
ctccagggatgattccttcc

SEQ ID NO: 565607 - DNA, 20 bp, Homo sapiens
atgtctgagtaactcccaca

SEQ ID NO: 565608 - DNA, 20 bp, Homo sapiens
tgtttaataccacaaaagcc

SEQ ID NO: 565609 - DNA, 20 bp, Homo sapiens
aaaaggcactggggtgggct

SEQ ID NO: 565610 - DNA, 20 bp, Homo sapiens
gttttactgggaggagaagt

SEQ ID NO: 565611 - DNA, 20 bp, Homo sapiens
aggttgttgtgttgttgttg

SEQ ID NO: 565612 - DNA, 20 bp, Homo sapiens
ttgagacatgctgtcccttt

SEQ ID NO: 565613 - DNA, 20 bp, Homo sapiens
catcttcggcagccgcctgg

SEQ ID NO: 565614 - DNA, 20 bp, Homo sapiens
tgatggcactctggcaccct

SEQ ID NO: 565615 - DNA, 20 bp, Homo sapiens
aaagtgcttccttttagagg

SEQ ID NO: 565616 - DNA, 20 bp, Homo sapiens
ggctgggatcctgtgtccca

SEQ ID NO: 565617 - DNA, 20 bp, Homo sapiens
atccttttgcctcctgcccc

SEQ ID NO: 565618 - DNA, 20 bp, Homo sapiens
tgggtttgtagaggggaagg

SEQ ID NO: 565619 - DNA, 20 bp, Homo sapiens
cactaaggaggggagaagtg

SEQ ID NO: 565620 - DNA, 20 bp, Homo sapiens
gttaaactaggctacaactc

SEQ ID NO: 565621 - DNA, 20 bp, Homo sapiens
cctgacagatttgggattaa

SEQ ID NO: 565622 - DNA, 20 bp, Homo sapiens
gtggccagtcctgagcagct

SEQ ID NO: 565623 - DNA, 20 bp, Homo sapiens
agcccagctatgtggcccac

SEQ ID NO: 565624 - DNA, 20 bp, Homo sapiens
ggagtaagagtctccctccc

SEQ ID NO: 565625 - DNA, 20 bp, Homo sapiens
ctgtgggcttgggtgggctg

SEQ ID NO: 565626 - DNA, 20 bp, Homo sapiens
tggttttgatttttattctt

SEQ ID NO: 565627 - DNA, 20 bp, Homo sapiens
gaggaatgtgaataaaaggc

SEQ ID NO: 565628 - DNA, 20 bp, Homo sapiens
attttacataagggtagagg

SEQ ID NO: 565629 - DNA, 20 bp, Homo sapiens
aagctgcagtgcttcatgta

SEQ ID NO: 565630 - DNA, 20 bp, Homo sapiens
gagtgggaggaaagatggga

SEQ ID NO: 565631 - DNA, 20 bp, Homo sapiens
agaggctggccgtgatgaat

SEQ ID NO: 565632 - DNA, 20 bp, Homo sapiens
cttcctttatttcactccac

SEQ ID NO: 565633 - DNA, 20 bp, Homo sapiens
gctacaaggctctttccctc

SEQ ID NO: 565634 - DNA, 20 bp, Homo sapiens
ttttccctaaggaggaagca

SEQ ID NO: 565635 - DNA, 20 bp, Homo sapiens
gcagatggcgaaatgagctt

SEQ ID NO: 565636 - DNA, 20 bp, Homo sapiens
tttttccacatgacttcatc

SEQ ID NO: 565637 - DNA, 20 bp, Homo sapiens
tgttgtagttggccagcagt

SEQ ID NO: 565638 - DNA, 20 bp, Homo sapiens
gagggggcggctgggggcgc

SEQ ID NO: 565639 - DNA, 20 bp, Homo sapiens
gctttcctctgcacagggaa

SEQ ID NO: 565640 - DNA, 20 bp, Homo sapiens
gttggggatgaggtcaggaa

SEQ ID NO: 565641 - DNA, 20 bp, Homo sapiens
cccttaaactagccaatcat

SEQ ID NO: 565642 - DNA, 20 bp, Homo sapiens
tagtcatatccttgctctgc

SEQ ID NO: 565643 - DNA, 20 bp, Homo sapiens
cagattcctgccatgcttgc

SEQ ID NO: 565644 - DNA, 20 bp, Homo sapiens
gcctctgagatctgagcccc

SEQ ID NO: 565645 - DNA, 20 bp, Homo sapiens
cttcatgctgtgaatgtgat

SEQ ID NO: 565646 - DNA, 20 bp, Homo sapiens
ttaggtaccctgtaatctaa

SEQ ID NO: 565647 - DNA, 20 bp, Homo sapiens
tcaggcctgacctgggctgt

SEQ ID NO: 565648 - DNA, 20 bp, Homo sapiens
cgtcatcacgtggtgacgca

SEQ ID NO: 565649 - DNA, 20 bp, Homo sapiens
tttcgcctttgggtcagggc

SEQ ID NO: 565650 - DNA, 20 bp, Homo sapiens
tctagagggagtcagtctgc

SEQ ID NO: 565651 - DNA, 20 bp, Homo sapiens
aacacacctggttaacctct

SEQ ID NO: 565652 - DNA, 20 bp, Homo sapiens
tgcagctggaaggaagcctg

SEQ ID NO: 565653 - DNA, 20 bp, Homo sapiens
taaggggaaggtggggaaag

SEQ ID NO: 565654 - DNA, 20 bp, Homo sapiens
tcttttcctgtccaggcaat

SEQ ID NO: 565655 - DNA, 20 bp, Homo sapiens
aatatctttgtaatcagcag

SEQ ID NO: 565656 - DNA, 20 bp, Homo sapiens
ccttcaggaggggaaggggc

SEQ ID NO: 565657 - DNA, 20 bp, Homo sapiens
gtgttggactatgttacttg

SEQ ID NO: 565658 - DNA, 20 bp, Homo sapiens
gggggcgggaggaagattgg

SEQ ID NO: 565659 - DNA, 20 bp, Homo sapiens
ccgtgtcctcagatctcagg

SEQ ID NO: 565660 - DNA, 20 bp, Homo sapiens
aaaagtactgggtttccaga

SEQ ID NO: 565661 - DNA, 20 bp, Homo sapiens
tactcagacattggcagggc

SEQ ID NO: 565662 - DNA, 20 bp, Homo sapiens
ttcctatgcatatacttctt

SEQ ID NO: 565663 - DNA, 20 bp, Homo sapiens
ggctccatgttctagttgtg

SEQ ID NO: 565664 - DNA, 20 bp, Homo sapiens
cttgtctgagcttcccatct

SEQ ID NO: 565665 - DNA, 20 bp, Homo sapiens
gatctggccttgacacagca

SEQ ID NO: 565666 - DNA, 20 bp, Homo sapiens
tcccaggttcatagctgcta

SEQ ID NO: 565667 - DNA, 20 bp, Homo sapiens
attcattcttgacaatgtca

SEQ ID NO: 565668 - DNA, 20 bp, Homo sapiens
cagaagatctttagctactg

SEQ ID NO: 565669 - DNA, 20 bp, Homo sapiens
gggctgccaatttcacagtt

SEQ ID NO: 565670 - DNA, 20 bp, Homo sapiens
gcctgggccggcggtgggta

SEQ ID NO: 565671 - DNA, 20 bp, Homo sapiens
ggtacctgcactccagcttc

SEQ ID NO: 565672 - DNA, 20 bp, Homo sapiens
ctacaaagggaagccctttc

SEQ ID NO: 565673 - DNA, 20 bp, Homo sapiens
cagaaagaaggcttcctttc

SEQ ID NO: 565674 - DNA, 20 bp, Homo sapiens
ttttgcgatgtgttcctaat

SEQ ID NO: 565675 - DNA, 20 bp, Homo sapiens
gagacactggatggaaaatg

SEQ ID NO: 565676 - DNA, 20 bp, Homo sapiens
atatggctcatcttcttcaa

SEQ ID NO: 565677 - DNA, 20 bp, Homo sapiens
tcctcacagacttcctttcc

SEQ ID NO: 565678 - DNA, 20 bp, Homo sapiens
gctgccagggcaggggctgg

SEQ ID NO: 565679 - DNA, 20 bp, Homo sapiens
aggaaatggccatccagctg

SEQ ID NO: 565680 - DNA, 20 bp, Homo sapiens
aattgcacggtatccatctg

SEQ ID NO: 565681 - DNA, 20 bp, Homo sapiens
tctatctttgagtcctctgc

SEQ ID NO: 565682 - DNA, 20 bp, Homo sapiens
cccggatgttgtactcgagg

SEQ ID NO: 565683 - DNA, 20 bp, Homo sapiens
tccacggtctaaataggtgt

SEQ ID NO: 565684 - DNA, 20 bp, Homo sapiens
tctgggtgcaagtggagggt

SEQ ID NO: 565685 - DNA, 20 bp, Homo sapiens
tgtccaccaaagcctgtgct

SEQ ID NO: 565686 - DNA, 20 bp, Homo sapiens
ggcagcgtctacacagatgt

SEQ ID NO: 565687 - DNA, 20 bp, Homo sapiens
actgtgggggagcaggagat

SEQ ID NO: 565688 - DNA, 20 bp, Homo sapiens
gaagtaggaaggaaagagaa

SEQ ID NO: 565689 - DNA, 20 bp, Homo sapiens
ttccttctccctctcttcta

SEQ ID NO: 565690 - DNA, 20 bp, Homo sapiens
gaccctggtctgcactctat

SEQ ID NO: 565691 - DNA, 20 bp, Homo sapiens
tgccaactctcttctttgag

SEQ ID NO: 565692 - DNA, 20 bp, Homo sapiens
attgacacttctgtgagtag

SEQ ID NO: 565693 - DNA, 20 bp, Homo sapiens
tgctggcttgccaagctcct

SEQ ID NO: 565694 - DNA, 20 bp, Homo sapiens
tcctgttcctgaaccttccc

SEQ ID NO: 565695 - DNA, 20 bp, Homo sapiens
gtgcacagtggaagagcagc

SEQ ID NO: 565696 - DNA, 20 bp, Homo sapiens
cctccctctctccactccct

SEQ ID NO: 565697 - DNA, 20 bp, Homo sapiens
tcatcccgggatagaggtct

SEQ ID NO: 565698 - DNA, 20 bp, Homo sapiens
gtcagggaggccatttagga

SEQ ID NO: 565699 - DNA, 20 bp, Homo sapiens
ggggactgaatggggtggtc

SEQ ID NO: 565700 - DNA, 20 bp, Homo sapiens
gattgtgtaagggtacagtt

SEQ ID NO: 565701 - DNA, 20 bp, Homo sapiens
ggtgcttcaccaggtggttg

SEQ ID NO: 565702 - DNA, 20 bp, Homo sapiens
cgccggcccttagcttccac

SEQ ID NO: 565703 - DNA, 20 bp, Homo sapiens
gctgtggccttgctggtctg

SEQ ID NO: 565704 - DNA, 20 bp, Homo sapiens
gggagggcttgttctgctgg

SEQ ID NO: 565705 - DNA, 20 bp, Homo sapiens
atgggagcagtggctttcag

SEQ ID NO: 565706 - DNA, 20 bp, Homo sapiens
ggcagattctttcttggctc

SEQ ID NO: 565707 - DNA, 20 bp, Homo sapiens
cctctctccgtgggatgcag

SEQ ID NO: 565708 - DNA, 20 bp, Homo sapiens
gatctgcctagaagtcaggc

SEQ ID NO: 565709 - DNA, 20 bp, Homo sapiens
atattttagggccaggagat

SEQ ID NO: 565710 - DNA, 20 bp, Homo sapiens
cgggaagtggagggaggaag

SEQ ID NO: 565711 - DNA, 20 bp, Homo sapiens
tgcgctgtcaaagtctttcc

SEQ ID NO: 565712 - DNA, 20 bp, Homo sapiens
gaatcgtgtgtacgtgaggg

SEQ ID NO: 565713 - DNA, 20 bp, Homo sapiens
tctttgaagacccatttgag

SEQ ID NO: 565714 - DNA, 20 bp, Homo sapiens
aggcagcttgaggagctgtt

SEQ ID NO: 565715 - DNA, 20 bp, Homo sapiens
cttctccttcctctttgagt

SEQ ID NO: 565716 - DNA, 20 bp, Homo sapiens
aattagatgagaggctatta

SEQ ID NO: 565717 - DNA, 20 bp, Homo sapiens
ccatgaatgtagtttggggg

SEQ ID NO: 565718 - DNA, 20 bp, Homo sapiens
gtgggaaggtggaagaaggg

SEQ ID NO: 565719 - DNA, 20 bp, Homo sapiens
ctcggctctctgcccgggct

SEQ ID NO: 565720 - DNA, 20 bp, Homo sapiens
cagctggacttcaaaggggg

SEQ ID NO: 565721 - DNA, 20 bp, Homo sapiens
gagtcatgtggctaaatctc

SEQ ID NO: 565722 - DNA, 20 bp, Homo sapiens
aaagtgcacccagttttggg

SEQ ID NO: 565723 - DNA, 20 bp, Homo sapiens
ttgggatgtttagcaagagt

SEQ ID NO: 565724 - DNA, 20 bp, Homo sapiens
cagggacaatgacaggtggt

SEQ ID NO: 565725 - DNA, 20 bp, Homo sapiens
aacgcacttccctttagagt

SEQ ID NO: 565726 - DNA, 20 bp, Homo sapiens
agacatctatcatagtgatg

SEQ ID NO: 565727 - DNA, 20 bp, Homo sapiens
agggggttcttttcctggga

SEQ ID NO: 565728 - DNA, 20 bp, Homo sapiens
ttttttccttttcctttgat

SEQ ID NO: 565729 - DNA, 20 bp, Homo sapiens
ttacacgcagccattactgc

SEQ ID NO: 565730 - DNA, 20 bp, Homo sapiens
attctcattacaatctttgt

SEQ ID NO: 565731 - DNA, 20 bp, Homo sapiens
tgcggctctaatttgggcac

SEQ ID NO: 565732 - DNA, 20 bp, Homo sapiens
taattgtttcaaaagccctt

SEQ ID NO: 565733 - DNA, 20 bp, Homo sapiens
tctgtttcggtatgtggtct

SEQ ID NO: 565734 - DNA, 20 bp, Homo sapiens
agccagagaaccattgttga

SEQ ID NO: 565735 - DNA, 20 bp, Homo sapiens
tgtatgagagagcctagcac

SEQ ID NO: 565736 - DNA, 20 bp, Homo sapiens
cacagctgtcttcctttgct

SEQ ID NO: 565737 - DNA, 20 bp, Homo sapiens
tactgtaaataatctttttg

SEQ ID NO: 565738 - DNA, 20 bp, Homo sapiens
ctggagtcagagagaggaca

SEQ ID NO: 565739 - DNA, 20 bp, Homo sapiens
tggtctttccagcctcacac

SEQ ID NO: 565740 - DNA, 20 bp, Homo sapiens
caaggtcggggctcaagtaa

SEQ ID NO: 565741 - DNA, 20 bp, Homo sapiens
ttacatctggacaaaggcca

SEQ ID NO: 565742 - DNA, 20 bp, Homo sapiens
tttgacaggaggtgtgagct

SEQ ID NO: 565743 - DNA, 20 bp, Homo sapiens
cctccctttcttcctccctg

SEQ ID NO: 565744 - DNA, 20 bp, Homo sapiens
tagcagcgggaacagttctg

SEQ ID NO: 565745 - DNA, 20 bp, Homo sapiens
tgtttgctgtatttccccag

SEQ ID NO: 565746 - DNA, 20 bp, Homo sapiens
gtgttgaggctgtcgttgga

SEQ ID NO: 565747 - DNA, 20 bp, Homo sapiens
cacctgccaggcctctggga

SEQ ID NO: 565748 - DNA, 20 bp, Homo sapiens
atctggtggcttccttttgt

SEQ ID NO: 565749 - DNA, 20 bp, Homo sapiens
tttgggaagtgacattttaa

SEQ ID NO: 565750 - DNA, 20 bp, Homo sapiens
aggggcctggagtggggagc

SEQ ID NO: 565751 - DNA, 20 bp, Homo sapiens
tgtagcctctcttgagtaga

SEQ ID NO: 565752 - DNA, 20 bp, Homo sapiens
ttgcccctgctcttcctccc

SEQ ID NO: 565753 - DNA, 20 bp, Homo sapiens
accgcccgctgcactttggc

SEQ ID NO: 565754 - DNA, 20 bp, Homo sapiens
tggggctgggagcaggagac

SEQ ID NO: 565755 - DNA, 20 bp, Homo sapiens
cttagtgtgtaggtgccagg

SEQ ID NO: 565756 - DNA, 20 bp, Homo sapiens
tccccggtcctgggttctct

SEQ ID NO: 565757 - DNA, 20 bp, Homo sapiens
gcagggcccagctcctgggc

SEQ ID NO: 565758 - DNA, 20 bp, Homo sapiens
ctctagagggaagcgctttc

SEQ ID NO: 565759 - DNA, 20 bp, Homo sapiens
ttcaccccaccctgccctgt

SEQ ID NO: 565760 - DNA, 20 bp, Homo sapiens
gaatcactgtgagatgggag

SEQ ID NO: 565761 - DNA, 20 bp, Homo sapiens
acaagaaaccagttatgtaa

SEQ ID NO: 565762 - DNA, 20 bp, Homo sapiens
ctgagccgtgctccttgctg

SEQ ID NO: 565763 - DNA, 20 bp, Homo sapiens
gaggggaggtattgtttgcc

SEQ ID NO: 565764 - DNA, 20 bp, Homo sapiens
tggaatggggctggggtcgg

SEQ ID NO: 565765 - DNA, 20 bp, Homo sapiens
tgagctgctttgtatttggc

SEQ ID NO: 565766 - DNA, 20 bp, Homo sapiens
agatcaactcttgccaaagc

SEQ ID NO: 565767 - DNA, 20 bp, Homo sapiens
tggcttcctggggatggcaa

SEQ ID NO: 565768 - DNA, 20 bp, Homo sapiens
tgcctggttactagggaaac

SEQ ID NO: 565769 - DNA, 20 bp, Homo sapiens
cagttcagactcttgatccc

SEQ ID NO: 565770 - DNA, 20 bp, Homo sapiens
ctaaatgagtgaatgaacaa

SEQ ID NO: 565771 - DNA, 20 bp, Homo sapiens
gttggctgggatggccgtct

SEQ ID NO: 565772 - DNA, 20 bp, Homo sapiens
tcctcagagaactccctccc

SEQ ID NO: 565773 - DNA, 20 bp, Homo sapiens
gagtagggcccaggctaggg

SEQ ID NO: 565774 - DNA, 20 bp, Homo sapiens
cccttttcatgcggccccat

SEQ ID NO: 565775 - DNA, 20 bp, Homo sapiens
tgaagggcagagggagggaa

SEQ ID NO: 565776 - DNA, 20 bp, Homo sapiens
ttcccagccaggccccctgc

SEQ ID NO: 565777 - DNA, 20 bp, Homo sapiens
cagtcagtgatgcacatacc

SEQ ID NO: 565778 - DNA, 20 bp, Homo sapiens
atggaggccctgtctgtgcc

SEQ ID NO: 565779 - DNA, 20 bp, Homo sapiens
gaatcaataaggtacttaac

SEQ ID NO: 565780 - DNA, 20 bp, Homo sapiens
aagcgcttcccttcagagtg

SEQ ID NO: 565781 - DNA, 20 bp, Homo sapiens
gcagaatgtctcttgcctca

SEQ ID NO: 565782 - DNA, 20 bp, Homo sapiens
gccatggcctctgccctgcc

SEQ ID NO: 565783 - DNA, 20 bp, Homo sapiens
tgattcaacttggcaggaga

SEQ ID NO: 565784 - DNA, 20 bp, Homo sapiens
tgtgaatcagtgtaactcat

SEQ ID NO: 565785 - DNA, 20 bp, Homo sapiens
aaggatgaatctttgttact

SEQ ID NO: 565786 - DNA, 20 bp, Homo sapiens
tcctggatgggagtctggtg

SEQ ID NO: 565787 - DNA, 20 bp, Homo sapiens
ggtgatatcagtggtttcca

SEQ ID NO: 565788 - DNA, 20 bp, Homo sapiens
ttgcagttctggctttgtaa

SEQ ID NO: 565789 - DNA, 20 bp, Homo sapiens
tcaagggtcacaggggcaga

SEQ ID NO: 565790 - DNA, 20 bp, Homo sapiens
aaagcgcttcccttcagagt

SEQ ID NO: 565791 - DNA, 20 bp, Homo sapiens
gcacagcagggtgacgggca

SEQ ID NO: 565792 - DNA, 20 bp, Homo sapiens
atctcaacccccagccactc

SEQ ID NO: 565793 - DNA, 20 bp, Homo sapiens
gaaacggatatttggccagg

SEQ ID NO: 565794 - DNA, 20 bp, Homo sapiens
tgtttgttgaattgaattga

SEQ ID NO: 565795 - DNA, 20 bp, Homo sapiens
tcagaagtgaggcaagcaaa

SEQ ID NO: 565796 - DNA, 20 bp, Homo sapiens
ctgggagaggacagatggcc

SEQ ID NO: 565797 - DNA, 20 bp, Homo sapiens
ttggagccagactttatttg

SEQ ID NO: 565798 - DNA, 20 bp, Homo sapiens
tgattggaaaaactagtttt

SEQ ID NO: 565799 - DNA, 19 bp, Homo sapiens
aaaaaggtgtttttattta

SEQ ID NO: 565800 - DNA, 19 bp, Homo sapiens
aacgcacttccctttagag

SEQ ID NO: 565801 - DNA, 19 bp, Homo sapiens
cctagagtctgggggctgc

SEQ ID NO: 565802 - DNA, 19 bp, Homo sapiens
gctctctccacaccctgga

SEQ ID NO: 565803 - DNA, 19 bp, Homo sapiens
aggagggggctgcctgggc

SEQ ID NO: 565804 - DNA, 19 bp, Homo sapiens
tgaggggtgagaccgatgg

SEQ ID NO: 565805 - DNA, 19 bp, Homo sapiens
agggtagaccatgtggtag

SEQ ID NO: 565806 - DNA, 19 bp, Homo sapiens
gttactgtggatttttaag

SEQ ID NO: 565807 - DNA, 19 bp, Homo sapiens
agaaaatgggcaaaacact

SEQ ID NO: 565808 - DNA, 19 bp, Homo sapiens
cgagccaccacctgcctgg

SEQ ID NO: 565809 - DNA, 19 bp, Homo sapiens
cgacccttgtcggggcagc

SEQ ID NO: 565810 - DNA, 19 bp, Homo sapiens
acacacctggttaacctct

SEQ ID NO: 565811 - DNA, 19 bp, Homo sapiens
tagagcttgccctctgggg

SEQ ID NO: 565812 - DNA, 19 bp, Homo sapiens
tgtcttgggccctggtccc

SEQ ID NO: 565813 - DNA, 19 bp, Homo sapiens
gcagctaggcaaggcaata

SEQ ID NO: 565814 - DNA, 19 bp, Homo sapiens
atgtacttactttgaggcc

SEQ ID NO: 565815 - DNA, 19 bp, Homo sapiens
tttattcaggtggcaggca

SEQ ID NO: 565816 - DNA, 19 bp, Homo sapiens
gaggagagggtttgggggt

SEQ ID NO: 565817 - DNA, 19 bp, Homo sapiens
cgaggaggacggaaggtgc

SEQ ID NO: 565818 - DNA, 19 bp, Homo sapiens
tccgccgcgcgccggatgt

SEQ ID NO: 565819 - DNA, 19 bp, Homo sapiens
ccaaacagaggatgaggag

SEQ ID NO: 565820 - DNA, 19 bp, Homo sapiens
tgtgctctggctcagcacc

SEQ ID NO: 565821 - DNA, 19 bp, Homo sapiens
ggaccctagtggcctgaga

SEQ ID NO: 565822 - DNA, 19 bp, Homo sapiens
ctcttgagggaagcacttt

SEQ ID NO: 565823 - DNA, 19 bp, Homo sapiens
ggtgggaacatggaaagga

SEQ ID NO: 565824 - DNA, 19 bp, Homo sapiens
ctaattagtacctaccctt

SEQ ID NO: 565825 - DNA, 19 bp, Homo sapiens
tctgttggcacagggggag

SEQ ID NO: 565826 - DNA, 19 bp, Homo sapiens
tctggctgagaggctgatt

SEQ ID NO: 565827 - DNA, 19 bp, Homo sapiens
atccgccaagcctgaggcc

SEQ ID NO: 565828 - DNA, 19 bp, Homo sapiens
tggtggaggtgcacctgac

SEQ ID NO: 565829 - DNA, 19 bp, Homo sapiens
aaggaccagctggcctctg

SEQ ID NO: 565830 - DNA, 19 bp, Homo sapiens
tgaagctccttgggaaaag

SEQ ID NO: 565831 - DNA, 19 bp, Homo sapiens
ttgtaagaaacagtatgta

SEQ ID NO: 565832 - DNA, 19 bp, Homo sapiens
tgttttgtcttctctttgg

SEQ ID NO: 565833 - DNA, 19 bp, Homo sapiens
tatttctgattccacttct

SEQ ID NO: 565834 - DNA, 19 bp, Homo sapiens
gttattacaggcagcagct

SEQ ID NO: 565835 - DNA, 19 bp, Homo sapiens
tcactggcttacccctcct

SEQ ID NO: 565836 - DNA, 19 bp, Homo sapiens
ggcacatcataaactgtta

SEQ ID NO: 565837 - DNA, 19 bp, Homo sapiens
ctgaggtttccaaattagt

SEQ ID NO: 565838 - DNA, 19 bp, Homo sapiens
gaaagcgcttctctttaga

SEQ ID NO: 565839 - DNA, 19 bp, Homo sapiens
tgagtgcctggacttgccc

SEQ ID NO: 565840 - DNA, 19 bp, Homo sapiens
tccatgctatgtttaagca

SEQ ID NO: 565841 - DNA, 19 bp, Homo sapiens
ttgctgctgatttttcatt

SEQ ID NO: 565842 - DNA, 19 bp, Homo sapiens
gtgagtgaggacaggcctc

SEQ ID NO: 565843 - DNA, 19 bp, Homo sapiens
tccatttcctgtgatgctc

SEQ ID NO: 565844 - DNA, 19 bp, Homo sapiens
cctcggtctggctcccacc

SEQ ID NO: 565845 - DNA, 19 bp, Homo sapiens
agaggctggccgtgatgaa

SEQ ID NO: 565846 - DNA, 19 bp, Homo sapiens
cgtgctctcaaagagctcg

SEQ ID NO: 565847 - DNA, 19 bp, Homo sapiens
cacgggggtggggagctgg

SEQ ID NO: 565848 - DNA, 19 bp, Homo sapiens
gtgcttgccattcagagtt

SEQ ID NO: 565849 - DNA, 19 bp, Homo sapiens
aggataaaaggacccatca

SEQ ID NO: 565850 - DNA, 19 bp, Homo sapiens
ggtggcagtaggatctacc

SEQ ID NO: 565851 - DNA, 19 bp, Homo sapiens
cagccaccgctgtctttct

SEQ ID NO: 565852 - DNA, 19 bp, Homo sapiens
gaagagagcagcagggtgg

SEQ ID NO: 565853 - DNA, 19 bp, Homo sapiens
agaggaagaatagtttgtc

SEQ ID NO: 565854 - DNA, 19 bp, Homo sapiens
tgcccctaaaaatccttat

SEQ ID NO: 565855 - DNA, 19 bp, Homo sapiens
aacacacctggttaacctc

SEQ ID NO: 565856 - DNA, 19 bp, Homo sapiens
ctttgaggaagccgagagc

SEQ ID NO: 565857 - DNA, 19 bp, Homo sapiens
caggctctgctccatcgcc

SEQ ID NO: 565858 - DNA, 19 bp, Homo sapiens
tcacacctgcccttgaacc

SEQ ID NO: 565859 - DNA, 19 bp, Homo sapiens
tgcaggtgggggagggggc

SEQ ID NO: 565860 - DNA, 19 bp, Homo sapiens
ttaagggggaggggaaaga

SEQ ID NO: 565861 - DNA, 19 bp, Homo sapiens
tcccttatctggcaggcag

SEQ ID NO: 565862 - DNA, 19 bp, Homo sapiens
ctcacagtgacacgagccc

SEQ ID NO: 565863 - DNA, 19 bp, Homo sapiens
tgggagagtgaattcagtt

SEQ ID NO: 565864 - DNA, 19 bp, Homo sapiens
ttgaagcctgaaggactgt

SEQ ID NO: 565865 - DNA, 19 bp, Homo sapiens
aagtgcttccttttagagg

SEQ ID NO: 565866 - DNA, 19 bp, Homo sapiens
tatgctgtaagttgtttga

SEQ ID NO: 565867 - DNA, 19 bp, Homo sapiens
gattgtgtaagggtacagt

SEQ ID NO: 565868 - DNA, 19 bp, Homo sapiens
tggttgctttggaaacgag

SEQ ID NO: 565869 - DNA, 19 bp, Homo sapiens
cagcctttgtgtggagggc

SEQ ID NO: 565870 - DNA, 19 bp, Homo sapiens
cagtccaggaaggtgtaag

SEQ ID NO: 565871 - DNA, 19 bp, Homo sapiens
aagaaaagaaaaagggatc

SEQ ID NO: 565872 - DNA, 19 bp, Homo sapiens
tccttttggcctctggcag

SEQ ID NO: 565873 - DNA, 19 bp, Homo sapiens
tgcatcaaatatgtaccac

SEQ ID NO: 565874 - DNA, 19 bp, Homo sapiens
gctggcctggctgctggga

SEQ ID NO: 565875 - DNA, 19 bp, Homo sapiens
tggcgatataaccatgtgc

SEQ ID NO: 565876 - DNA, 19 bp, Homo sapiens
agctctctccttccttctc

SEQ ID NO: 565877 - DNA, 19 bp, Homo sapiens
gctgggatattcaagggga

SEQ ID NO: 565878 - DNA, 19 bp, Homo sapiens
caaagcgcttctctttaga

SEQ ID NO: 565879 - DNA, 19 bp, Homo sapiens
tatgtgctttcaagtgagg

SEQ ID NO: 565880 - DNA, 19 bp, Homo sapiens
cccggccggaaaccccttc

SEQ ID NO: 565881 - DNA, 19 bp, Homo sapiens
cttctctctctctgttacc

SEQ ID NO: 565882 - DNA, 19 bp, Homo sapiens
gtctccatgcagaaggaag

SEQ ID NO: 565883 - DNA, 19 bp, Homo sapiens
tggtttgcagagcgttttg

SEQ ID NO: 565884 - DNA, 19 bp, Homo sapiens
aagagaaggctaaagtaca

SEQ ID NO: 565885 - DNA, 19 bp, Homo sapiens
tcgatgtttatcatggcag

SEQ ID NO: 565886 - DNA, 19 bp, Homo sapiens
caaggttctagcaattaat

SEQ ID NO: 565887 - DNA, 19 bp, Homo sapiens
tcccgccatccccagtccc

SEQ ID NO: 565888 - DNA, 19 bp, Homo sapiens
caactgtgaacatatcaag

SEQ ID NO: 565889 - DNA, 19 bp, Homo sapiens
ggactgggaagtgagggac

SEQ ID NO: 565890 - DNA, 19 bp, Homo sapiens
tccctgttgctaagaaaga

SEQ ID NO: 565891 - DNA, 19 bp, Homo sapiens
attgctctttggatttgcc

SEQ ID NO: 565892 - DNA, 19 bp, Homo sapiens
actgcttggccgagggtcc

SEQ ID NO: 565893 - DNA, 19 bp, Homo sapiens
attagctacttggaaggat

SEQ ID NO: 565894 - DNA, 19 bp, Homo sapiens
tcctttatgaagtctccct

SEQ ID NO: 565895 - DNA, 19 bp, Homo sapiens
aatgttcagttaagtgctt

SEQ ID NO: 565896 - DNA, 19 bp, Homo sapiens
cacagagacgtctgacttc

SEQ ID NO: 565897 - DNA, 19 bp, Homo sapiens
catctcctttttctgagtt

SEQ ID NO: 565898 - DNA, 19 bp, Homo sapiens
tacagcagagcagctggtg

SEQ ID NO: 565899 - DNA, 19 bp, Homo sapiens
tagcagcttcctgtggggc

SEQ ID NO: 565900 - DNA, 19 bp, Homo sapiens
agagtctgcgggtcagaga

SEQ ID NO: 565901 - DNA, 19 bp, Homo sapiens
cctcctttcaaagataccc

SEQ ID NO: 565902 - DNA, 19 bp, Homo sapiens
tccgcgcgccccctgcctg

SEQ ID NO: 565903 - DNA, 19 bp, Homo sapiens
tgacaagctgccataacac

SEQ ID NO: 565904 - DNA, 19 bp, Homo sapiens
ccttttcacatgttttctc

SEQ ID NO: 565905 - DNA, 19 bp, Homo sapiens
tcatttaggcagcttctga

SEQ ID NO: 565906 - DNA, 19 bp, Homo sapiens
taaagccggcccatcttcc

SEQ ID NO: 565907 - DNA, 19 bp, Homo sapiens
gtaaggaggatcagacagg

SEQ ID NO: 565908 - DNA, 19 bp, Homo sapiens
cctggggcatggtgggttt

SEQ ID NO: 565909 - DNA, 19 bp, Homo sapiens
agttcacatcctagtattc

SEQ ID NO: 565910 - DNA, 19 bp, Homo sapiens
gggcgcctggctgaggctg

SEQ ID NO: 565911 - DNA, 19 bp, Homo sapiens
tggagtactgaaagatcta

SEQ ID NO: 565912 - DNA, 19 bp, Homo sapiens
gcaattgagtcctgtgtgc

SEQ ID NO: 565913 - DNA, 19 bp, Homo sapiens
aagaagtgaggctcttgga

SEQ ID NO: 565914 - DNA, 19 bp, Homo sapiens
tgggttgggtgaggatctc

SEQ ID NO: 565915 - DNA, 19 bp, Homo sapiens
gtgcatccttttagagtgt

SEQ ID NO: 565916 - DNA, 19 bp, Homo sapiens
acagcagccagagtgaggt

SEQ ID NO: 565917 - DNA, 19 bp, Homo sapiens
ctccagagggatgcacttt

SEQ ID NO: 565918 - DNA, 19 bp, Homo sapiens
tgaagtgcttccgacagcc

SEQ ID NO: 565919 - DNA, 19 bp, Homo sapiens
cgggagcaggtgtgggctc

SEQ ID NO: 565920 - DNA, 19 bp, Homo sapiens
aaattttgccatgatcttt

SEQ ID NO: 565921 - DNA, 19 bp, Homo sapiens
cccaccctcatctcctagg

SEQ ID NO: 565922 - DNA, 19 bp, Homo sapiens
agaaggagagtcctcagga

SEQ ID NO: 565923 - DNA, 19 bp, Homo sapiens
aggggtggggagggtgagg

SEQ ID NO: 565924 - DNA, 19 bp, Homo sapiens
tactcaggagagtggcaat

SEQ ID NO: 565925 - DNA, 19 bp, Homo sapiens
tattcttcaacattgtaga

SEQ ID NO: 565926 - DNA, 19 bp, Homo sapiens
cctctggcttgaaagggaa

SEQ ID NO: 565927 - DNA, 19 bp, Homo sapiens
cctttcccttcctttccac

SEQ ID NO: 565928 - DNA, 19 bp, Homo sapiens
cctagagaggaattgttta

SEQ ID NO: 565929 - DNA, 19 bp, Homo sapiens
ctgcttgctcgctcgcgcc

SEQ ID NO: 565930 - DNA, 19 bp, Homo sapiens
gacattgggtggctgtctg

SEQ ID NO: 565931 - DNA, 19 bp, Homo sapiens
tggatcctctgattggaca

SEQ ID NO: 565932 - DNA, 19 bp, Homo sapiens
tttctgtcttttcggatca

SEQ ID NO: 565933 - DNA, 18 bp, Homo sapiens
tgtgatggaaataacagg

SEQ ID NO: 565934 - DNA, 18 bp, Homo sapiens
atccccatgcacccaccc

SEQ ID NO: 565935 - DNA, 18 bp, Homo sapiens
tgtgacgacttccctcct

SEQ ID NO: 565936 - DNA, 18 bp, Homo sapiens
caggagcccctgaccacc

SEQ ID NO: 565937 - DNA, 18 bp, Homo sapiens
aggctagggacctggggt

SEQ ID NO: 565938 - DNA, 18 bp, Homo sapiens
accttgggcttcttgctt

SEQ ID NO: 565939 - DNA, 18 bp, Homo sapiens
cggggcttggggacaggg

SEQ ID NO: 565940 - DNA, 18 bp, Homo sapiens
ccgtcctgggagctctgg

SEQ ID NO: 565941 - DNA, 18 bp, Homo sapiens
ggttctggcttgcttaca

SEQ ID NO: 565942 - DNA, 18 bp, Homo sapiens
gtttgcatttgcagctgt

SEQ ID NO: 565943 - DNA, 18 bp, Homo sapiens
ggtatcaggagaatggct

SEQ ID NO: 565944 - DNA, 18 bp, Homo sapiens
atggctctgagacacgga

SEQ ID NO: 565945 - DNA, 18 bp, Homo sapiens
atgagtttactcttttct

SEQ ID NO: 565946 - DNA, 18 bp, Homo sapiens
tgtatgttgtgacttcta

SEQ ID NO: 565947 - DNA, 18 bp, Homo sapiens
caaatagctgtagtatgc

SEQ ID NO: 565948 - DNA, 18 bp, Homo sapiens
tgatccaaaggtgtaatt

SEQ ID NO: 565949 - DNA, 18 bp, Homo sapiens
tggatgacctccttcctg

SEQ ID NO: 565950 - DNA, 18 bp, Homo sapiens
tgtgcagcagagggtgtc

SEQ ID NO: 565951 - DNA, 18 bp, Homo sapiens
cccagcctcaggacactt

SEQ ID NO: 565952 - DNA, 18 bp, Homo sapiens
ccgactctcccgcccgcg

SEQ ID NO: 565953 - DNA, 18 bp, Homo sapiens
ttgaaggtcgtgacagaa

SEQ ID NO: 565954 - DNA, 18 bp, Homo sapiens
tcctgtgatgtgggcctc

SEQ ID NO: 565955 - DNA, 18 bp, Homo sapiens
cagagagaccagtgggga

SEQ ID NO: 565956 - DNA, 18 bp, Homo sapiens
ggtcagttgtttacccct

SEQ ID NO: 565957 - DNA, 18 bp, Homo sapiens
aaatggggagaaggcagg

SEQ ID NO: 565958 - DNA, 18 bp, Homo sapiens
tcgtccttgaggatccac

SEQ ID NO: 565959 - DNA, 18 bp, Homo sapiens
aatggtacagtggacacc

SEQ ID NO: 565960 - DNA, 18 bp, Homo sapiens
cgggcagcgactggctgg

SEQ ID NO: 565961 - DNA, 18 bp, Homo sapiens
acaggagatacagagaga

SEQ ID NO: 565962 - DNA, 18 bp, Homo sapiens
catgttgtactggaatag

SEQ ID NO: 565963 - DNA, 18 bp, Homo sapiens
ttgccttaggagcagacc

SEQ ID NO: 565964 - DNA, 18 bp, Homo sapiens
tttgtctccaggacacac

SEQ ID NO: 565965 - DNA, 18 bp, Homo sapiens
acaccctggccccttgtc

SEQ ID NO: 565966 - DNA, 18 bp, Homo sapiens
ggtgtgctgggagaaggg

SEQ ID NO: 565967 - DNA, 18 bp, Homo sapiens
ctctccactgtggtacag

SEQ ID NO: 565968 - DNA, 18 bp, Homo sapiens
tgaatcccattcatttta

SEQ ID NO: 565969 - DNA, 18 bp, Homo sapiens
tgaaggagggggcggtgg

SEQ ID NO: 565970 - DNA, 18 bp, Homo sapiens
gagaggtgagctgagggg

SEQ ID NO: 565971 - DNA, 18 bp, Homo sapiens
tctttgaggcagctcagt

SEQ ID NO: 565972 - DNA, 18 bp, Homo sapiens
cttagtcagaggaggcca

SEQ ID NO: 565973 - DNA, 18 bp, Homo sapiens
gagcagaaggcgccgccg

SEQ ID NO: 565974 - DNA, 18 bp, Homo sapiens
tttgtgccctttctgcct

SEQ ID NO: 565975 - DNA, 18 bp, Homo sapiens
tcgacagaacatatttgt

SEQ ID NO: 565976 - DNA, 18 bp, Homo sapiens
gccagagccctgccaagc

SEQ ID NO: 565977 - DNA, 18 bp, Homo sapiens
atgttctaatgcattaga

SEQ ID NO: 565978 - DNA, 18 bp, Homo sapiens
tgtcatttgggctgggct

SEQ ID NO: 565979 - DNA, 18 bp, Homo sapiens
tgggctctgtctctaact

SEQ ID NO: 565980 - DNA, 18 bp, Homo sapiens
tgcttcctttcagagggt

SEQ ID NO: 565981 - DNA, 18 bp, Homo sapiens
tacaggttgtcatcaatt

SEQ ID NO: 565982 - DNA, 18 bp, Homo sapiens
ggagatgtggtgatttca

SEQ ID NO: 565983 - DNA, 18 bp, Homo sapiens
aggtaaagcagaaagtga

SEQ ID NO: 565984 - DNA, 18 bp, Homo sapiens
atgtcttcagatctcagg

SEQ ID NO: 565985 - DNA, 18 bp, Homo sapiens
aagggagacaagttggca

SEQ ID NO: 565986 - DNA, 18 bp, Homo sapiens
gcctttcatttccagttg

SEQ ID NO: 565987 - DNA, 18 bp, Homo sapiens
gggtgcgaggctgtgggg

SEQ ID NO: 565988 - DNA, 18 bp, Homo sapiens
ttgaatctaggggaagat

SEQ ID NO: 565989 - DNA, 18 bp, Homo sapiens
cctctctcgagttcgcct

SEQ ID NO: 565990 - DNA, 18 bp, Homo sapiens
atctggttgcttggctga

SEQ ID NO: 565991 - DNA, 18 bp, Homo sapiens
tggggcttgggctggatg

SEQ ID NO: 565992 - DNA, 18 bp, Homo sapiens
tcaagttctgactgatat

SEQ ID NO: 565993 - DNA, 18 bp, Homo sapiens
ctgactgagtttttttct

SEQ ID NO: 565994 - DNA, 18 bp, Homo sapiens
gggaaatgttttcggtgt

SEQ ID NO: 565995 - DNA, 18 bp, Homo sapiens
aggacctgcgggacaaga

SEQ ID NO: 565996 - DNA, 18 bp, Homo sapiens
agggcaggcctggctctg

SEQ ID NO: 565997 - DNA, 18 bp, Homo sapiens
ccctcctctctgcagccc

SEQ ID NO: 565998 - DNA, 18 bp, Homo sapiens
agtctgatgtttgagtct

SEQ ID NO: 565999 - DNA, 18 bp, Homo sapiens
tgttctgtctttctccca

SEQ ID NO: 566000 - DNA, 18 bp, Homo sapiens
ctgggaatttataccaaa

SEQ ID NO: 566001 - DNA, 18 bp, Homo sapiens
acagactggggaccagcc

SEQ ID NO: 566002 - DNA, 18 bp, Homo sapiens
ttggttttaaaagccaaa

SEQ ID NO: 566003 - DNA, 18 bp, Homo sapiens
ttctaagaacagggtcct

SEQ ID NO: 566004 - DNA, 18 bp, Homo sapiens
atgagcatcctgcagcag

SEQ ID NO: 566005 - DNA, 18 bp, Homo sapiens
ggaatgtgttgggatgga

SEQ ID NO: 566006 - DNA, 18 bp, Homo sapiens
agttggcggggtgatggg

SEQ ID NO: 566007 - DNA, 18 bp, Homo sapiens
tcttatggggccaggggg

SEQ ID NO: 566008 - DNA, 18 bp, Homo sapiens
acgcaagaagggcggagc

SEQ ID NO: 566009 - DNA, 18 bp, Homo sapiens
aacaaggcctgtctaaaa

SEQ ID NO: 566010 - DNA, 18 bp, Homo sapiens
aggtgggggcacatatgt

SEQ ID NO: 566011 - DNA, 17 bp, Homo sapiens
cagccctcactcacaat

SEQ ID NO: 566012 - DNA, 17 bp, Homo sapiens
aagtccccatggggtct

SEQ ID NO: 566013 - DNA, 17 bp, Homo sapiens
ctgcctgtgctcctccc

SEQ ID NO: 566014 - DNA, 17 bp, Homo sapiens
ggggcaggtagagaggg

SEQ ID NO: 566015 - DNA, 17 bp, Homo sapiens
tcatttcccatatatca

SEQ ID NO: 566016 - DNA, 17 bp, Homo sapiens
ttcctggattctgtttc

SEQ ID NO: 566017 - DNA, 17 bp, Homo sapiens
gctactgtgggaggaag

SEQ ID NO: 566018 - DNA, 17 bp, Homo sapiens
gagctccgggcgccggc

SEQ ID NO: 566019 - DNA, 17 bp, Homo sapiens
ctcccattcttgtccca

SEQ ID NO: 566020 - DNA, 17 bp, Homo sapiens
cggatccgcgggaccgc

SEQ ID NO: 566021 - DNA, 17 bp, Homo sapiens
gtaatcctcaaggggag

SEQ ID NO: 566022 - DNA, 17 bp, Homo sapiens
cagtgacacagccccca

SEQ ID NO: 566023 - DNA, 17 bp, Homo sapiens
tgtcaagtgaggaggga

SEQ ID NO: 566024 - DNA, 17 bp, Homo sapiens
gttctctctccttctca

SEQ ID NO: 566025 - DNA, 17 bp, Homo sapiens
aggaactaggaatggga

SEQ ID NO: 566026 - DNA, 17 bp, Homo sapiens
tgcactagatgcacctt

SEQ ID NO: 566027 - DNA, 17 bp, Homo sapiens
gaagactacggttccca

SEQ ID NO: 566028 - DNA, 17 bp, Homo sapiens
tgccatggtcctttggg

SEQ ID NO: 566029 - DNA, 17 bp, Homo sapiens
cttacaatctagctggg

SEQ ID NO: 566030 - DNA, 17 bp, Homo sapiens
tctctgcctagaagtgg

SEQ ID NO: 566031 - DNA, 17 bp, Homo sapiens
ttggccctgtctggggc

SEQ ID NO: 566032 - DNA, 17 bp, Homo sapiens
ccctcactcaattttcc

SEQ ID NO: 566033 - DNA, 17 bp, Homo sapiens
agggaggtagagtagga

SEQ ID NO: 566034 - DNA, 17 bp, Homo sapiens
taggagcagaacccgaa

SEQ ID NO: 566035 - DNA, 17 bp, Homo sapiens
atgtacttgggtatata

SEQ ID NO: 566036 - DNA, 17 bp, Homo sapiens
gttggttaaagtgaaag

SEQ ID NO: 566037 - DNA, 17 bp, Homo sapiens
ttcaggggctgaatgtg

SEQ ID NO: 566038 - DNA, 17 bp, Homo sapiens
aatctgtagacctcatt

SEQ ID NO: 566039 - DNA, 17 bp, Homo sapiens
gtcctgactcagccttt

SEQ ID NO: 566040 - DNA, 17 bp, Homo sapiens
tgaattccataggctgt

SEQ ID NO: 566041 - DNA, 17 bp, Homo sapiens
gaaagttcaagcttgtc

SEQ ID NO: 566042 - DNA, 17 bp, Homo sapiens
ggctgtgcgctcctgcc

SEQ ID NO: 566043 - DNA, 17 bp, Homo sapiens
cacttgttctcgagcca

SEQ ID NO: 566044 - DNA, 17 bp, Homo sapiens
cactctttcatcttggg

SEQ ID NO: 566045 - DNA, 17 bp, Homo sapiens
tctagtgatctgaagtc

SEQ ID NO: 566046 - DNA, 17 bp, Homo sapiens
caggaggcctgctcatc

SEQ ID NO: 566047 - DNA, 17 bp, Homo sapiens
aggcagctggggtatcc

SEQ ID NO: 566048 - DNA, 17 bp, Homo sapiens
gcatctggcccacaaag

SEQ ID NO: 566049 - DNA, 17 bp, Homo sapiens
ctgagttcttcatgttt

SEQ ID NO: 566050 - DNA, 17 bp, Homo sapiens
tagctggtggctgagca

SEQ ID NO: 566051 - DNA, 17 bp, Homo sapiens
tttctagcagggcagga

SEQ ID NO: 566052 - DNA, 17 bp, Homo sapiens
gagacagagacagatgg

SEQ ID NO: 566053 - DNA, 17 bp, Homo sapiens
tttccaacctctcacct

SEQ ID NO: 566054 - DNA, 17 bp, Homo sapiens
tgccgtagacccatgtt

SEQ ID NO: 566055 - DNA, 17 bp, Homo sapiens
ctgtctacgaaccagtc

SEQ ID NO: 566056 - DNA, 17 bp, Homo sapiens
attacatggccaatctc

SEQ ID NO: 566057 - DNA, 17 bp, Homo sapiens
ttcaggttttttccact

SEQ ID NO: 566058 - DNA, 17 bp, Homo sapiens
acaatcagttagaaagc

SEQ ID NO: 566059 - DNA, 17 bp, Homo sapiens
ctgggagagaggtgttt

SEQ ID NO: 566060 - DNA, 17 bp, Homo sapiens
tgggcttgggtttgtag

SEQ ID NO: 566061 - DNA, 17 bp, Homo sapiens
ctctaagtggcgcatgt

SEQ ID NO: 566062 - DNA, 17 bp, Homo sapiens
gtggggcagcaaaagca

SEQ ID NO: 566063 - DNA, 17 bp, Homo sapiens
cccaccgggggatgaat

SEQ ID NO: 566064 - DNA, 17 bp, Homo sapiens
agcaaaagctattgttt

SEQ ID NO: 566065 - DNA, 16 bp, Homo sapiens
cagatctgagggacct

SEQ ID NO: 566066 - DNA, 16 bp, Homo sapiens
tcctgctgtctttctt

SEQ ID NO: 566067 - DNA, 16 bp, Homo sapiens
ggttggcccacctcgc

SEQ ID NO: 566068 - DNA, 16 bp, Homo sapiens
tgggtggagacttgat

SEQ ID NO: 566069 - DNA, 16 bp, Homo sapiens
tgcggcggccctggaa

SEQ ID NO: 566070 - DNA, 16 bp, Homo sapiens
gtcagaagtgaatgcc

SEQ ID NO: 566071 - DNA, 16 bp, Homo sapiens
ggagctgggatggaga

SEQ ID NO: 566072 - DNA, 16 bp, Homo sapiens
agttttttggtgcctt

SEQ ID NO: 566073 - DNA, 16 bp, Homo sapiens
ggggtgggtgacagac

SEQ ID NO: 566074 - DNA, 16 bp, Homo sapiens
gtgcgatggcagctga

SEQ ID NO: 566075 - DNA, 16 bp, Homo sapiens
aaaccttatagggtag

SEQ ID NO: 566076 - DNA, 16 bp, Homo sapiens
gcttatgaacaccccc

SEQ ID NO: 566077 - DNA, 16 bp, Homo sapiens
cggggagggggtgctg

SEQ ID NO: 566078 - DNA, 16 bp, Homo sapiens
agactgtctgggtttg

SEQ ID NO: 566079 - DNA, 16 bp, Homo sapiens
cttcgcctttgacacc

SEQ ID NO: 566080 - DNA, 16 bp, Homo sapiens
agggaggggagggctc

SEQ ID NO: 566081 - DNA, 16 bp, Homo sapiens
tgctggctgcttgatt

SEQ ID NO: 566082 - DNA, 16 bp, Homo sapiens
ttgccagccaagcttc

SEQ ID NO: 566083 - DNA, 16 bp, Homo sapiens
cagctgtggtgagaga

SEQ ID NO: 566084 - DNA, 16 bp, Homo sapiens
gagcaccactggggta

SEQ ID NO: 566085 - DNA, 16 bp, Homo sapiens
caggaatagtagttga

SEQ ID NO: 566086 - DNA, 16 bp, Homo sapiens
tgtgtgctctgcagaa

SEQ ID NO: 566087 - DNA, 16 bp, Homo sapiens
gtcttaggagaagttt

SEQ ID NO: 566088 - DNA, 16 bp, Homo sapiens
gcccttcatccccagc

SEQ ID NO: 566089 - DNA, 16 bp, Homo sapiens
tgaactggggtcctgg

SEQ ID NO: 566090 - DNA, 16 bp, Homo sapiens
ccctcctggcagtggc

SEQ ID NO: 566091 - DNA, 16 bp, Homo sapiens
cccagcagcctggctg

SEQ ID NO: 566092 - DNA, 15 bp, Homo sapiens
cattggcaatggggt

SEQ ID NO: 566093 - DNA, 15 bp, Homo sapiens
aggctgaggcccctc

SEQ ID NO: 566094 - DNA, 15 bp, Homo sapiens
cttccctcctgccgg

SEQ ID NO: 566095 - DNA, 15 bp, Homo sapiens
ggagacagagaccag

SEQ ID NO: 566096 - DNA, 15 bp, Homo sapiens
gggagaggggagggc

SEQ ID NO: 566097 - DNA, 15 bp, Homo sapiens
tccaccagtggctct

SEQ ID NO: 566098 - DNA, 15 bp, Homo sapiens
gaaggctgaggcaca

SEQ ID NO: 566099 - DNA, 15 bp, Homo sapiens
ttgaatgtaagctcc

SEQ ID NO: 566100 - DNA, 15 bp, Homo sapiens
atgttttctctaagt

SEQ ID NO: 566101 - DNA, 15 bp, Homo sapiens
gagggttattgaagt

SEQ ID NO: 566102 - DNA, 15 bp, Homo sapiens
gtctctatggcaatt

SEQ ID NO: 566103 - DNA, 15 bp, Homo sapiens
ggagtcagaggatcg

SEQ ID NO: 566104 - DNA, 15 bp, Homo sapiens
aacagaggctgacat

SEQ ID NO: 566105 - DNA, 185 bp, Homo sapiens
tacattttcccggatggaagcccgaagtttgagggagaaacttgtgaggaaataaaggaagttaggctgaggggcagagagcgagacttttctattttccaaaagctcggtctgaggcccctcagtcttgcttcctaacccgcgcttgagtttctccccgcttggatgctctcaggggcagtgtg

SEQ ID NO: 566106 - DNA, 176 bp, Homo sapiens
aggatgctgcccggggacggggtggcagagaggccccgaagcctgtgcctggcctgaggagcagggcttagctgcttgtgagcagggtccacaccaagtcgtgttcacagtggctaagttccgccccccaggccctcacctcctctggccttgccgcctgtcccctgctgccgcct

SEQ ID NO: 566107 - DNA, 167 bp, Homo sapiens
cgcccgccttgcgtccagcctgccgggggctcccaggccggcgcccgagctctggctccgtgtcttcactcccgtgcttgtccgaggagggagggagggacgggggctgtgctggggcagctggaacaacgcaggtcgccgggccggctgggcgagttggccgggcg

SEQ ID NO: 566108 - DNA, 162 bp, Homo sapiens
cagtgtgtgcagacagcacggggtggcgctgctctcaggtgctctggctgcttgggttcctggcatgctgatttgtgacttaagattaaaatcacattgccagggattaccacgcaaccacgaccttggctgctcctccagaaaccgtggtcgcgctcactg

SEQ ID NO: 566109 - DNA, 159 bp, Homo sapiens
agtctacctgagctgaaagcactcccaaggagtttggttttgtttgggtttgttctaggtatggtcccagggatcccagatcaaaccaggcccctgggcctatcctagaaccaacctaagctcgcgcatcattcctggaacatcaagagtgtgaagact

SEQ ID NO: 566110 - DNA, 159 bp, Homo sapiens
ctcccgtgcgcctccctcccttccccgccccgggccgcggctcctgattgtccaaacgcaattctcgagtctatggctccggccgagagttgagtctggacgtcccgagccgccgcccccaaacctcgagcgggagagcgggtcggagggtctagggag

SEQ ID NO: 566111 - DNA, 159 bp, Homo sapiens
ggcttgtatgggaccatgcagccagagggtgacagagccacccagggctcctgactccaggtcctgtgtgttacctagaaatagcactggacttggagtcagaaggcctgagtggagtcaccttccccactctctggctgggtgaccccggagcaagcc

SEQ ID NO: 566112 - DNA, 152 bp, Homo sapiens
gcctggtgctagtcactggggcaaagatgactaaaacacttttcctgccctcgaggagctcacagtctagtatgtctcatcccctactagactgaagctccttgaggacagggatggtcatactcacctcggtgttgcccaaacctccaggc

SEQ ID NO: 566113 - DNA, 149 bp, Homo sapiens
atatgtcgtgccaagagagcaagcccttccctgctccctctctcacatcccttgcatggtggagggtgagctttctgaaaacccctcccacatgcagggtttgcaggatggcgagcctcagctttccttgctctcttgtgcatgtgtat

SEQ ID NO: 566114 - DNA, 147 bp, Homo sapiens
gtctgtctgtcgggtctgtccacctgccgcgccccccgggctgaggtaggaggttgtatagttgaggaggacacccaaggagatcactatacggcctcctagctttccccaggctgcgccctgcacgggacggggcccggcggggac

SEQ ID NO: 566115 - DNA, 144 bp, Homo sapiens
gcagtgggtcttatactttccggatcaagattagaggctctgctctccgtgttcacagcggaccttgatttaatgtcatacaattaaggcacgcggtgaatgccaagagcggagcctacggctgcacttgaaggacaccaaagc

SEQ ID NO: 566116 - DNA, 138 bp, Homo sapiens
ggaggagggttgcggcccgtagtcagtagttggggggtgggaacggcttcatacaggagttgatgcacagttatccagctcctatatgatgcctttcttcatccccttcaaccacgcgcagcccccggaccctcctct

SEQ ID NO: 566117 - DNA, 135 bp, Homo sapiens
gcctcaactgatttctaaaaccgtttgtacctggtgtgattataaagcaatgagactgattgtcatatgtcgtttgtgggatccgtctcagttactttatagccatacctggtatcttataccacagatcatggc

SEQ ID NO: 566118 - DNA, 134 bp, Homo sapiens
gcactcccaaggagtttggttttgtttgggtttgttctaggtatggtcccagggatcccagatcaaaccaggcccctgggcctatcctagaaccaacctaagctcgcgcatcattcctggaacatcaagagtgt

SEQ ID NO: 566119 - DNA, 134 bp, Homo sapiens
gaggaagccggcggagttctggtatcgttgctgcagctggtgttgtgaatcaggccgacgagcagcgcatcctcttacccggctatttcacgacaccagggttgcatcatacccatcctctccaggcgagcctc

SEQ ID NO: 566120 - DNA, 132 bp, Homo sapiens
gctcttggcctggcctcctgcagtgccacgctccgtgtatttgacaagctgagttggacactccatgtggtagagtgtcagtttgtcaaataccccaagtgcggcacatgcttaccagctctaggccagggc

SEQ ID NO: 566121 - DNA, 128 bp, Homo sapiens
gtgacagagaagataaggcccaggggctttcaagtcactagtggttccgtttagtagatgattgtgcattgtttcaaaatggtgccctagtgactacaaagccccagagccagcatcatcatcaaagc

SEQ ID NO: 566122 - DNA, 124 bp, Homo sapiens
gctccctcgccccaccctgcccgggacccagttcaagtaattcaggataggttgtgtgctgtccagcctgttctccattacttggctcggggaccggtgccctgcagccttggggtgagggggc

SEQ ID NO: 566123 - DNA, 122 bp, Homo sapiens
ggtgggctgccgagaccgagtgcacagggctctgacctatgaattgacagccagtgctctcgtctcccctctggctgccaattccataggtcacaggtatgttcgcctcaatgccagccacc

SEQ ID NO: 566124 - DNA, 120 bp, Homo sapiens
ggtctatctgatgtgacagcttctgtagcactaaagtgcttatagtgcaggtagtgtttagttatctactgcattatgagcacttaaagtactgctagctgtagaactccagcttcggcc

SEQ ID NO: 566125 - DNA, 119 bp, Homo sapiens
gatcccccttcattgactccgaggggatacagcagcaattcatgttttgaagtgttctaaatggttcaaaacgtgaggcgctgctataccccctcgtggggaaggtagaaggtggggtc

SEQ ID NO: 566126 - DNA, 118 bp, Homo sapiens
gcgccctgtgtgtgtctctctctgtgtcctgccagtggttttaccctatggtaggttacgtcatgctgttctaccacagggtagaaccacggacaggataccggggcaccctctgcgt

SEQ ID NO: 566127 - DNA, 118 bp, Homo sapiens
ctgcccagtgctattgtttggtacttaaagcgaggttgccctttgtatattcggtttattgacatggaatatacaagggcaagctctctgtgagtatcaaaccttgtcttggacccag

SEQ ID NO: 566128 - DNA, 118 bp, Homo sapiens
cctgggggaggcactggcaggcctgcccgacactctttccctgttgcactactataggccgctgggaagcagtgcaatgatgaaagggcatcggtcaggtccagcctgctaccctggg

SEQ ID NO: 566129 - DNA, 117 bp, Homo sapiens
gcttctgttgcagaacctgagtgtgcatcgtggtcaaatgctcagactcctgtggtggctgctcatgcaccacggatgtttgagcatgtgctacggtgtctacttttgctacattgc

SEQ ID NO: 566130 - DNA, 117 bp, Homo sapiens
tccggatcaagattagaggctctgctctccgtgttcacagcggaccttgatttaatgtcatacaattaaggcacgcggtgaatgccaagagcggagcctacggctgcacttgaagga

SEQ ID NO: 566131 - DNA, 116 bp, Homo sapiens
ttcattggatgttggcctagttctgtgtggaagactagtgattttgttgtttttagataactaaatcgacaacaaatcacagtctgccatatggcacaggccatgcctctacagga

SEQ ID NO: 566132 - DNA, 116 bp, Homo sapiens
cagctgctggaaggtgtaggtaccctcaatggctcagtagccagtgtagatcctgtctttcgtaatcagcagctacatctggctactgggtctctgatggcatcttctagcttctg

SEQ ID NO: 566133 - DNA, 114 bp, Homo sapiens
ccaaggagtttggttttgtttgggtttgttctaggtatggtcccagggatcccagatcaaaccaggcccctgggcctatcctagaaccaacctaagctcgcgcatcattcctgg

SEQ ID NO: 566134 - DNA, 112 bp, Homo sapiens
atgttgcagatcttctgtgtgtgcatcgtggtcaaatgctcagactcctgtggtggctgcttatgcaccacggatgtttgagcatgtgctatggtgtctacttttgcaacat

SEQ ID NO: 566135 - DNA, 112 bp, Homo sapiens
gtgttcctttcctacttattactgctaacgaatgctctgactttattgcactactgtactttacagctagcagtgcaatagtattgtcaaagcatctgaaagcaggatgcac

SEQ ID NO: 566136 - DNA, 111 bp, Homo sapiens
cccattctgcttgctctggtggagatattgcacattactaagttgcatgttgtcacggcctcaatgcaatttagtgtgtgtgatattttcacatgagtgcatgcacacggg

SEQ ID NO: 566137 - DNA, 109 bp, Homo sapiens
ttgtgactgcatgctcccaggttgaggtagtaggttgtatagtttagaattacatcaagggagataactgtacagcctcctagctttccttgggtcttgcactaaacaa

SEQ ID NO: 566138 - DNA, 108 bp, Homo sapiens
gccctggcgaaggccgtggcctcgttcaagtaatccaggataggctgtgcaggtcccaatgggcctattcttggttacttgcacggggacgcgggcctggacgccggc

SEQ ID NO: 566139 - DNA, 107 bp, Homo sapiens
gaacatccaggtctggggcatgaacctggcatacaatgtagatttctgtgttcgttaggcaacagctacattgtctgctgggtttcaggctacctggaaacatgttc

SEQ ID NO: 566140 - DNA, 106 bp, Homo sapiens
gcgggtgcccggtgctcggtttgtaggcagtgtcattagctgattgtactgtggtggttacaatcactaactccactgccatcaaaacaaggcacagcatcaccgc

SEQ ID NO: 566141 - DNA, 105 bp, Homo sapiens
gaggacacctccactccgtctacccagtgtttagactatctgttcaggactcccaaattgtacagtagtctgcacattggttaggctgggctgggttagaccctc

SEQ ID NO: 566142 - DNA, 105 bp, Homo sapiens
cagaaccaatacagtgcttggttcctagtaggtgtccagtaagtgtttgtgacataatttgtttattgaggacctcctatcaatcaagcactgtgctaggctctg

SEQ ID NO: 566143 - DNA, 105 bp, Homo sapiens
gtgaaactgggctcaaggtgaggggtgctatctgtgattgagggacatggttaatggaattgtctcacacagaaatcgcacccgtcaccttggcctacttatcac

SEQ ID NO: 566144 - DNA, 104 bp, Homo sapiens
gtcggccggccctgggtccatcttccagtacagtgttggatggtctaattgtgaagctcctaacactgtctggtaaagatggctcccgggtgggttctctcggc

SEQ ID NO: 566145 - DNA, 104 bp, Homo sapiens
ggctggacagagttgtcatgtgtctgcctgtctacacttgctgtgcagaacatccgctcacctgtacagcaggcacagacaggcagtcacatgacaacccagcc

SEQ ID NO: 566146 - DNA, 103 bp, Homo sapiens
caccatggccctggctgaggtagtagtttgtgctgttggtcgggttgtgacattgcccgctgtggagataactgcgcaagctactgccttgctagtgctggtg

SEQ ID NO: 566147 - DNA, 103 bp, Homo sapiens
aatgggttcctaggaagaggtagtaggttgcatagttttagggcagggattttgcccacaaggaggtaactatacgacctgctgcctttcttagggccttatt

SEQ ID NO: 566148 - DNA, 102 bp, Homo sapiens
cctgattccaggctgaggtagtagtttgtacagtttgagggtctatgataccacccggtacaggagataactgtacaggccactgccttgccaggaacagcg

SEQ ID NO: 566149 - DNA, 102 bp, Homo sapiens
ttgctctatcagagtgaggtagtagattgtatagttgtggggtagtgattttaccctgttcaggagataactatacaatctattgccttccctgaggagtag

SEQ ID NO: 566150 - DNA, 101 bp, Homo sapiens
cgcaggggcggggcggccgctctccctgtcctccaggagctcacgtgtgcctgcctgtgagcgcctcgacgacagagccggcgcctgccccagtgtctgcg

SEQ ID NO: 566151 - DNA, 99 bp, Homo sapiens
ttctgtgaccccttagaggatgactgatttcttttggtgttcagagtcaatataattttctagcaccatctgaaatcggttataatgattggggaagag

SEQ ID NO: 566152 - DNA, 99 bp, Homo sapiens
actgaacactgttctatggttagttttgcaggtttgcatccagctgtgtgatattctgctgtgcaaatccatgcaaaactgactgtggtagtgaaaagt

SEQ ID NO: 566153 - DNA, 98 bp, Homo sapiens
gtggaccggctggccccatctggaagactagtgattttgttgttgtcttactgcgctcaacaacaaatcccagtctacctaatggtgccagccatcgc

SEQ ID NO: 566154 - DNA, 98 bp, Homo sapiens
aggcggcgcttcgctcccctccgccttctcttcccggttcttcccggagtcgggaaaagctgggttgagagggcgaaaaaggatgaggtgactggtct

SEQ ID NO: 566155 - DNA, 97 bp, Homo sapiens
catgccagggtgaggtagtaagttgtattgttgtggggtagggatattaggccccaattagaagataactatacaacttactactttccctggtgtg

SEQ ID NO: 566156 - DNA, 97 bp, Homo sapiens
tgttgcgctcctctcagtccctgagaccctaacttgtgatgtttaccgtttaaatccacgggttaggctcttgggagctgcgagtcgtgcttttgca

SEQ ID NO: 566157 - DNA, 96 bp, Homo sapiens
gctgcgtctttgtgctttcagcttctttacagtgctgccttgtagcattcaggtcaagcagcattgtacagggctatgaaagaaccaagaatgggc

SEQ ID NO: 566158 - DNA, 96 bp, Homo sapiens
acattgctacttacaattagttttgcaggtttgcatttcagcgtatatatgtatatgtggctgtgcaaatccatgcaaaactgattgtgataatgt

SEQ ID NO: 566159 - DNA, 96 bp, Homo sapiens
acctctctaacaaggtgcagagcttagctgattggtgaacagtgattggtttccgctttgttcacagtggctaagttctgcacctgaagagaaggt

SEQ ID NO: 566160 - DNA, 94 bp, Homo sapiens
gccaaatgctttgctagagctggtaaaatggaaccaaatcgactgtccaatggatttggtccccttcaaccagctgtagctgtgcattgatggc

SEQ ID NO: 566161 - DNA, 94 bp, Homo sapiens
gaataggccttggccatgtaaaagtgcttacagtgcaggtagctttttgagatctactgcaatgtaagcacttcttacattaccatggtgattt

SEQ ID NO: 566162 - DNA, 94 bp, Homo sapiens
caaacccctttctacacaggttgggatcggttgcaatgctgtgtttctgtatggtattgcacttgtcccggcctgttgagtttggtggggattg

SEQ ID NO: 566163 - DNA, 94 bp, Homo sapiens
gtagcgagattttctgttgtgcttgatctaaccatgtggttgcgaggtatgagtaaaacatggttccgtcaagcaccatggaacgtcacgcagc

SEQ ID NO: 566164 - DNA, 93 bp, Homo sapiens
gaggacacgagagaagcactggacttagggtcagaaggcctgagtctctctgctgcagatgggctctctgtccctgagccaagctttgtcctc

SEQ ID NO: 566165 - DNA, 92 bp, Homo sapiens
cacccagcttccctggctctagcagcacagaaatattggcacagggaagcgagtctgccaatattggctgtgctgctccaggcagggtggtg

SEQ ID NO: 566166 - DNA, 92 bp, Homo sapiens
gtgtgcatccgggttgaggtagtaggttgtatggtttagagttacaccctgggagttaactgtacaaccttctagctttccttggagcacac

SEQ ID NO: 566167 - DNA, 92 bp, Homo sapiens
tgtgctctgggggctgtgccgggtagagagggcagtgggaggtaagagctcttcacccttcaccaccttctccacccagcatggccggcaca

SEQ ID NO: 566168 - DNA, 92 bp, Homo sapiens
ttggctacaggccattactgttgctaatatgcaactctgttgaatataaattggaattgcactttagcaatggtgatggattgttaagccaa

SEQ ID NO: 566169 - DNA, 91 bp, Homo sapiens
gttgggtgggctcccttcaactttaacatggaagtgctttctgtgactttaaaagtaagtgcttccatgttttagtaggagtgaatccaat

SEQ ID NO: 566170 - DNA, 91 bp, Homo sapiens
ctcagagcctggagtgggggggcaggaggggctcagggagaaagtgcatacagcccctggccctctctgcccttccgtcccctgctcttgg

SEQ ID NO: 566171 - DNA, 90 bp, Homo sapiens
gacacagtgtgagacctcgggctacaacacaggacccgggcgctgctctgacccctcgtgtcttgtgttgcagccggagggacgcaggtc

SEQ ID NO: 566172 - DNA, 90 bp, Homo sapiens
gccctttggggtgaggtagtaggttgtatagtttggggctctgccctgctatgggataactatacaatctactgtctttcctgaagtggc

SEQ ID NO: 566173 - DNA, 90 bp, Homo sapiens
ggctggacagcgggcaacggaatcccaaaagcagctgttgtctccagagcattccagctgcgcttggatttcgtcccctgctctcctgcc

SEQ ID NO: 566174 - DNA, 90 bp, Homo sapiens
ggacagcgcgccggcaccttggctctagactgcttactgcccgggccgccctcagtaacagtctccagtcacggccaccgacgcctggcc

SEQ ID NO: 566175 - DNA, 90 bp, Homo sapiens
ggcagtctttgctactgtaaacatccttgactggaagctgtaaggtgttcagaggagctttcagtcggatgtttacagcggcaggctgcc

SEQ ID NO: 566176 - DNA, 90 bp, Homo sapiens
gtttttgatgtcgcagatactgcatcaggaactgattggataagaatcagtcaccatcagttcctaatgcattgccttcagcatctaaac

SEQ ID NO: 566177 - DNA, 90 bp, Homo sapiens
gtgagtgtttctttggcagtgtcttagctggttgttgtgagcaatagtaaggaagcaatcagcaagtatactgccctagaagtgctgcac

SEQ ID NO: 566178 - DNA, 90 bp, Homo sapiens
gtaccaccttgtcgggtagcttatcagactgatgttgactgttgaatctcatggcaacaccagtcgatgggctgtctgacattttggtat

SEQ ID NO: 566179 - DNA, 90 bp, Homo sapiens
gtctcctttggatctttttgcggtctgggcttgctgttcctctcaacagtagtcaggaagcccttaccccaaaaagtatctgcgggaggc

SEQ ID NO: 566180 - DNA, 90 bp, Homo sapiens
tctgcttggccgattttggcactagcacatttttgcttgtgtctctccgctctgagcaatcatgtgcagtgccaatatgggaaaagcagg

SEQ ID NO: 566181 - DNA, 90 bp, Homo sapiens
tcttcttctggaagctggtttcacatggtggcttagatttttccatctttgtatctagcaccatttgaaatcagtgttttaggagtaaga

SEQ ID NO: 566182 - DNA, 89 bp, Homo sapiens
gtcagcagtgccttagcagcacgtaaatattggcgttaagattctaaaattatctccagtattaactgtgctgctgaagtaaggttgac

SEQ ID NO: 566183 - DNA, 89 bp, Homo sapiens
ggggcttcgccactgattgtccaaacgcaattcttgtacgagtctgcggccaaccgagaattgtggctggacatctgtggctgagctcc

SEQ ID NO: 566184 - DNA, 89 bp, Homo sapiens
taggctgtatgctgttaatgctaatcgtgataggggtttttgcctccaactgactcctacatattagcattaacagtgtatgatgcctg

SEQ ID NO: 566185 - DNA, 89 bp, Homo sapiens
ctggctcaggtgtattctacagtgcacgtgtctccagtgtggctcggaggctggagacgcggccctgttggagtaacaactgaagccgg

SEQ ID NO: 566186 - DNA, 88 bp, Homo sapiens
cttcttctggaagctggtttcacatggtggcttagatttttccatctttgtatctagcaccatttgaaatcagtgttttaggagtaag

SEQ ID NO: 566187 - DNA, 88 bp, Homo sapiens
gaggcccgtttctctctttggttatctagctgtatgagtgccacagagccgtcataaagctagataaccgaaagtagaaatgattctc

SEQ ID NO: 566188 - DNA, 88 bp, Homo sapiens
gggatttgggagcttatcagaatctccaggggtactttataatttcaaaaagtcccccaggtgtgattctgatttgcttccttttcct

SEQ ID NO: 566189 - DNA, 88 bp, Homo sapiens
gcccttcgcgaatctttttgcggtctgggcttgctgtacataactcaatagccggaagcccttaccccaaaaagcatttgcggagggc

SEQ ID NO: 566190 - DNA, 88 bp, Homo sapiens
attagcatttgaggtgaagttctgttatacactcaggctgtggctctctgaaagtcagtgcatcacagaactttgtctcgaaagcttt

SEQ ID NO: 566191 - DNA, 88 bp, Homo sapiens
gtttgacccttgagcagaggttgcccttggtgaattcgctttatttatgttgaatcacacaaaggcaacttttgtttgagtatcaaat

SEQ ID NO: 566192 - DNA, 88 bp, Homo sapiens
actgcaagaacaataaggatttttaggggcattatgactgagtcagaaaacacagctgcccctgaaagtccctcatttttcttgctgt

SEQ ID NO: 566193 - DNA, 87 bp, Homo sapiens
ggggttggttgttatctttggttatctagctgtatgagtggtgtggagtcttcataaagctagataaccgaaagtaaaaataacccc

SEQ ID NO: 566194 - DNA, 87 bp, Homo sapiens
ggttgcttcagtgaacattcaacgctgtcggtgagtttggaattaaaatcaaaaccatcgaccgttgattgtaccctatggctaacc

SEQ ID NO: 566195 - DNA, 87 bp, Homo sapiens
tccatgtgcttctcttgtccttcattccaccggagtctgtctcatacccaaccagatttcagtggagtgaagttcaggaggcatgga

SEQ ID NO: 566196 - DNA, 87 bp, Homo sapiens
tctgtctgttgggctggaggcagggcctttgtgaaggcgggtggtgctcagatcgcctctgggcccttcctccagccccgaggcgga

SEQ ID NO: 566197 - DNA, 87 bp, Homo sapiens
tgccccctgctctggctggtcaaacggaaccaagtccgtcttcctgagaggtttggtccccttcaaccagctacagcagggctggca

SEQ ID NO: 566198 - DNA, 87 bp, Homo sapiens
tgggtcctggcacccacccgtagaaccgaccttgcggggccttcgccgcacacaagctcgtgtctgtgggtccgtgtcgggggctca

SEQ ID NO: 566199 - DNA, 87 bp, Homo sapiens
ttcactctagtgctttatggctttttattcctatgtgatagtaataaagtctcatgtagggatggaagccatgaaatacattgtgaa

SEQ ID NO: 566200 - DNA, 87 bp, Homo sapiens
tggtgtggtggggcagctggtgttgtgaatcaggccgttgccaatcagagaacggctacttcacaacaccagggccacaccacacta

SEQ ID NO: 566201 - DNA, 87 bp, Homo sapiens
cctccccccgtttttggcaatggtagaactcacactggtgaggtaacaggatccggtggttctagacttgccaactatggggcgagg

SEQ ID NO: 566202 - DNA, 87 bp, Homo sapiens
ccagacttttcctagtccctgagaccctaacttgtgaggtattttagtaacatcacaagtcaggctcttgggacctaggcggagggg

SEQ ID NO: 566203 - DNA, 87 bp, Homo sapiens
ccatgctgtagtgtgtgtaaacatcctacactctcagctgtgagctcaaggtggctgggagagggttgtttactccttctgccatgg

SEQ ID NO: 566204 - DNA, 87 bp, Homo sapiens
gctgctggccagagctcttttcacattgtgctactgtctgcacctgtcactagcagtgcaatgttaaaagggcattggccgtgtagt

SEQ ID NO: 566205 - DNA, 87 bp, Homo sapiens
gctcatactgggatactcaaaatgggggcgctttcctttttgtctgtactgggaagtgcttcgattttggggtgtccctgtttgagt

SEQ ID NO: 566206 - DNA, 87 bp, Homo sapiens
ggcgggcagctgtggtgcattgtagttgcattgcatgttctggtggtacccatgcaatgtttccacagtgcatcacagaggcctgcc

SEQ ID NO: 566207 - DNA, 87 bp, Homo sapiens
gaaagcgctttggaatgacacgatcactcccgttgagtgggcacccgagaagccatcgggaatgtcgtgtccgcccagtgctctttc

SEQ ID NO: 566208 - DNA, 87 bp, Homo sapiens
cttgttccactctagcagcacgtaaatattggcgtagtgaaatatatattaaacaccaatattactgtgctgctttagtgtgacagg

SEQ ID NO: 566209 - DNA, 86 bp, Homo sapiens
ctctgtgtcctgccagtggttttaccctatggtaggttacgtcatgctgttctaccacagggtagaaccacggacaggataccggg

SEQ ID NO: 566210 - DNA, 86 bp, Homo sapiens
cgttgtctatatataccctgtagaaccgaatttgtgtggtatccgtatagtcacagattcgattctaggggaatatatggtcgatg

SEQ ID NO: 566211 - DNA, 86 bp, Homo sapiens
gggcgggggccctcgtcttacccagcagtgtttgggtgcggttgggagtctctaatactgccgggtaatgatggaggcccctgtcc

SEQ ID NO: 566212 - DNA, 86 bp, Homo sapiens
gccctgccggggctaaagtgctgacagtgcagatagtggtcctctccgtgctaccgcactgtgggtacttgctgctccagcagggc

SEQ ID NO: 566213 - DNA, 86 bp, Homo sapiens
ccaagtttcagttcatgtaaacatcctacactcagctgtaatacatggattggctgggaggtggatgtttacttcagctgacttgg

SEQ ID NO: 566214 - DNA, 86 bp, Homo sapiens
cacagctgccagtgtcatttttgtgatctgcagctagtattctcactccagttgcatagtcacaaaagtgatcattggcaggtgtg

SEQ ID NO: 566215 - DNA, 86 bp, Homo sapiens
caatgctttgctagagctggtaaaatggaaccaaatcgcctcttcaatggatttggtccccttcaaccagctgtagctatgcattg

SEQ ID NO: 566216 - DNA, 86 bp, Homo sapiens
ttctctctgctttcagcttctttacagtgttgccttgtggcatggagttcaagcagcattgtacagggctatcaaagcacagagag

SEQ ID NO: 566217 - DNA, 86 bp, Homo sapiens
tttggtatttaaaaggtagattctccttctatgagtacattatttatgattaatcatagaggaaaatccacgttttcagtatcaaa

SEQ ID NO: 566218 - DNA, 86 bp, Homo sapiens
tttggtatttaaaaggtggatattccttctatgtttatgttatttatggttaaacatagaggaaattccacgttttcagtatcaaa

SEQ ID NO: 566219 - DNA, 86 bp, Homo sapiens
tctcttacacaggctgaccgatttctcctggtgttcagagtctgtttttgtctagcaccatttgaaatcggttatgatgtaggggg

SEQ ID NO: 566220 - DNA, 86 bp, Homo sapiens
gtcctgggggctccaaagtgctgttcgtgcaggtagtgtgattacccaacctactgctgagctagcacttcccgagcccccgggac

SEQ ID NO: 566221 - DNA, 86 bp, Homo sapiens
gtctgtctgcccgcatgcctgcctctctgttgctctgaaggaggcaggggctgggcctgcagctgcctgggcagagcggctcctgc

SEQ ID NO: 566222 - DNA, 86 bp, Homo sapiens
gttaaatcaggaattttaaacaattcctagacaatatgtataatgttcataagtcattcctagaaattgttcataatgcctgtaac

SEQ ID NO: 566223 - DNA, 85 bp, Homo sapiens
gtcccccccggcccaggttctgtgatacactccgactcgggctctggagcagtcagtgcatgacagaacttgggcccggaaggac

SEQ ID NO: 566224 - DNA, 85 bp, Homo sapiens
tggttcccgccccctgtaacagcaactccatgtggaagtgcccactggttccagtggggctgctgttatctggggcgagggccag

SEQ ID NO: 566225 - DNA, 85 bp, Homo sapiens
cacctgctcctcagatcagaaggtgattgtggctttgggtggatattaatcagccacagcactgcctggtcagaaagagcaagtg

SEQ ID NO: 566226 - DNA, 85 bp, Homo sapiens
gctcaccctgtgggcctcaaatgtggagcactattctgatgtccaagtggaaagtgctgcgacatttgagcgtcaccggtgacgc

SEQ ID NO: 566227 - DNA, 85 bp, Homo sapiens
gcggtggccagtgtcatttttgtgatgttgcagctagtaatatgagcccagttgcatagtcacaaaagtgatcattggaaactgt

SEQ ID NO: 566228 - DNA, 85 bp, Homo sapiens
gggctctgcctcccgtgcctactgagctgaaacacagttggtttgtgtacactggctcagttcagcaggaacaggggtcaagccc

SEQ ID NO: 566229 - DNA, 85 bp, Homo sapiens
gctttttgttctaaggtgcatctagtgcagatagtgaagtagattagcatctactgccctaagtgctccttctggcataagaagt

SEQ ID NO: 566230 - DNA, 85 bp, Homo sapiens
cggctgtcctctccaacaatatcctggtgctgagtgatgactcaggcgactccagcatcagtgattttgttgaagagggcagctg

SEQ ID NO: 566231 - DNA, 85 bp, Homo sapiens
gaagcgagttgttatctttggttatctagctgtatgagtgtattggtcttcataaagctagataaccgaaagtaaaaactccttc

SEQ ID NO: 566232 - DNA, 85 bp, Homo sapiens
gagggcccctctgcgtgttcacagcggaccttgatttaatgtctatacaattaaggcacgcggtgaatgccaagagaggcgcctc

SEQ ID NO: 566233 - DNA, 85 bp, Homo sapiens
acagtgcagtcacccataaagtagaaagcactactaacagcactggagggtgtagtgtttcctactttatggatgagtgtactgt

SEQ ID NO: 566234 - DNA, 84 bp, Homo sapiens
aactggtcggtgatttaggtagtttcctgttgttgggatccacctttctctcgacagcacgacactgccttcattacttcagtt

SEQ ID NO: 566235 - DNA, 84 bp, Homo sapiens
gaggactccaaggaacattcaacgctgtcggtgagtttgggatttgaaaaaaccactgaccgttgactgtaccttggggtcctt

SEQ ID NO: 566236 - DNA, 84 bp, Homo sapiens
gcttcccgaggccacatgcttctttatatccccatatggattactttgctatggaatgtaaggaagtgtgtggtttcggcaagt

SEQ ID NO: 566237 - DNA, 84 bp, Homo sapiens
ggacccgccctccggtgcctactgagctgatatcagttctcattttacacactggctcagttcagcaggaacaggagtcgagcc

SEQ ID NO: 566238 - DNA, 84 bp, Homo sapiens
ggctgtggctggattcaagtaatccaggataggctgtttccatctgtgaggcctattcttgattacttgtttctggaggcagct

SEQ ID NO: 566239 - DNA, 84 bp, Homo sapiens
gccacggccggctggggttcctggggatgggatttgcttcctgtcacaaatcacattgccagggatttccaaccgaccctgagc

SEQ ID NO: 566240 - DNA, 84 bp, Homo sapiens
gccagtctctaggtccctgagaccctttaacctgtgaggacatccagggtcacaggtgaggttcttgggagcctggcgtctggc

SEQ ID NO: 566241 - DNA, 84 bp, Homo sapiens
ccaggcgcagggcagcccctgcccaccgcacactgcgctgccccagacccactgtgcgtgtgacagcggctgatctgtgcctgg

SEQ ID NO: 566242 - DNA, 84 bp, Homo sapiens
cctcgctgttctctatggctttttattcctatgtgattctactgctcactcatatagggattggagccgtggcgcacggcgggg

SEQ ID NO: 566243 - DNA, 84 bp, Homo sapiens
ccttaaagtactgtagcagcacatcatggtttacatgctacagtcaagatgcgaatcattatttgctgctctagaaatttaagg

SEQ ID NO: 566244 - DNA, 84 bp, Homo sapiens
ccttgtcctcacggtccagttttcccaggaatcccttagatgctaagatggggattcctggaaatactgttcttgaggtcatgg

SEQ ID NO: 566245 - DNA, 84 bp, Homo sapiens
aggggccccctctactttaacatggaggcacttgctgtgacatgacaaaaataagtgcttccatgtttgagtgtggtggttcct

SEQ ID NO: 566246 - DNA, 84 bp, Homo sapiens
tcttactgccctcggcttctttacagtgctgccttgttgcatatggatcaagcagcattgtacagggctatgaaggcattgaga

SEQ ID NO: 566247 - DNA, 84 bp, Homo sapiens
gtcagaataatgtcaaagtgcttacagtgcaggtagtgatatgtgcatctactgcagtgaaggcacttgtagcattatggtgac

SEQ ID NO: 566248 - DNA, 84 bp, Homo sapiens
ggtcttttgaggcaaagttctgagacactccgactctgagtatgatagaagtcagtgcactacagaactttgtctctagaggct

SEQ ID NO: 566249 - DNA, 83 bp, Homo sapiens
ggggctttcaagtcactagtggttccgtttagtagatgattgtgcattgtttcaaaatggtgccctagtgactacaaagcccc

SEQ ID NO: 566250 - DNA, 83 bp, Homo sapiens
gtctagtgctgtgtggaagactagtgattttgttgttctgatgtactacgacaacaagtcacagccggcctcatagcgcagac

SEQ ID NO: 566251 - DNA, 83 bp, Homo sapiens
tggtgttatcaagtgtaacagcaactccatgtggactgtgtaccaatttccagtggagatgctgttacttttgatggttacca

SEQ ID NO: 566252 - DNA, 83 bp, Homo sapiens
tgtgggatgaggtagtagattgtatagttttagggtcataccccatcttggagataactatacagtctactgtctttcccacg

SEQ ID NO: 566253 - DNA, 83 bp, Homo sapiens
caaaccctaggtctgctgactcctagtccagggctcgtgatggctggtgggccctgaacgaggggtctggaggcctgggtttg

SEQ ID NO: 566254 - DNA, 83 bp, Homo sapiens
ccttggagtaaagtagcagcacataatggtttgtggattttgaaaaggtgcaggccatattgtgctgcctcaaaaatacaagg

SEQ ID NO: 566255 - DNA, 83 bp, Homo sapiens
cctgaatctaaagacaacatttctgcacacacaccagactatggaagccagtgtgtggaaatgcttctgctagattctgaagg

SEQ ID NO: 566256 - DNA, 83 bp, Homo sapiens
cctactcagagtacatacttctttatgtacccatatgaacatacaatgctatggaatgtaaagaagtatgtatttttggtagg

SEQ ID NO: 566257 - DNA, 83 bp, Homo sapiens
gctggcgacgggacattattacttttggtacgcgctgtgacacttcaaactcgtaccgtgagtaataatgcgccgtccacggc

SEQ ID NO: 566258 - DNA, 83 bp, Homo sapiens
ggccccgccaacccagtgttcagactacctgttcaggaggctctcaatgtgtacagtagtctgcacattggttaggctgggct

SEQ ID NO: 566259 - DNA, 83 bp, Homo sapiens
ggcctctctctccgtgttcacagcggaccttgatttaaatgtccatacaattaaggcacgcggtgaatgccaagaatggggct

SEQ ID NO: 566260 - DNA, 83 bp, Homo sapiens
cttagcagagctgtggagtgtgacaatggtgtttgtgtctaaactatcaaacgccattatcacactaaatagctactgctagg

SEQ ID NO: 566261 - DNA, 83 bp, Homo sapiens
cggggtgaggtagtaggttgtgtggtttcagggcagtgatgttgcccctcggaagataactatacaacctactgccttccctg

SEQ ID NO: 566262 - DNA, 83 bp, Homo sapiens
actctcttcggtgacgggtattcttgggtggataatacggattacgttgttattgcttaagaatacgcgtagtcgaggagagt

SEQ ID NO: 566263 - DNA, 82 bp, Homo sapiens
gcctgttgccacaaacccgtagatccgaacttgtggtattagtccgcacaagcttgtatctataggtatgtgtctgttaggc

SEQ ID NO: 566264 - DNA, 82 bp, Homo sapiens
gccagtgttgagaggcggagacttgggcaattgctggacgctgccctgggcattgcacttgtctcggtctgacagtgccggc

SEQ ID NO: 566265 - DNA, 82 bp, Homo sapiens
gcagtcctctgttagttttgcatagttgcactacaagaagaatgtagttgtgcaaatctatgcaaaactgatggtggcctgc

SEQ ID NO: 566266 - DNA, 82 bp, Homo sapiens
cccattggcataaacccgtagatccgatcttgtggtgaagtggaccgcacaagctcgcttctatgggtctgtgtcagtgtgg

SEQ ID NO: 566267 - DNA, 82 bp, Homo sapiens
cagtcacgtccccttatcacttttccagcccagctttgtgactgtaagtgttggacggagaactgataagggtaggtgattg

SEQ ID NO: 566268 - DNA, 82 bp, Homo sapiens
tggtacttgaagagaagttgttcgtggtggattcgctttacttatgacgaatcattcacggacaacacttttttcagtacca

SEQ ID NO: 566269 - DNA, 82 bp, Homo sapiens
tggtacttgaagataggttatccgtgttgccttcgctttatttgtgacgaatcatacacggttgacctatttttcagtacca

SEQ ID NO: 566270 - DNA, 82 bp, Homo sapiens
tgcggtacttgaagaaatggtttaccgtcccacatacattttgaatatgtatgtgggatggtaaaccgcttcttggtatcca

SEQ ID NO: 566271 - DNA, 82 bp, Homo sapiens
gtgacttgtgggcttccctttgtcatccttcgcctagggctctgagcagggcagggacagcaaaggggtgctcagttgtcac

SEQ ID NO: 566272 - DNA, 82 bp, Homo sapiens
tccccatggccctgtctcccaacccttgtaccagtgctgggctcagaccctggtacaggcctgggggacagggacctgggga

SEQ ID NO: 566273 - DNA, 81 bp, Homo sapiens
tcctgtgacgggcgagcttttggcccgggttatacctgatgctcacgtataagacgagcaaaaagcttgttggtcagagga

SEQ ID NO: 566274 - DNA, 81 bp, Homo sapiens
gggtttgggggaacattcaacctgtcggtgagtttgggcagctcaggcaaaccatcgaccgttgagtggaccctgaggcct

SEQ ID NO: 566275 - DNA, 81 bp, Homo sapiens
tggctgcactcaacattcattgctgtcggtgggtttgagtctgaatcaactcactgatcaatgaatgcaaactgcggacca

SEQ ID NO: 566276 - DNA, 81 bp, Homo sapiens
tggtacttgaagggagatcgaccgtgttatattcgctttattgacttcgaataatacatggttgatcttttctcagtatca

SEQ ID NO: 566277 - DNA, 81 bp, Homo sapiens
agtgagcgactgtaaacatcctcgactggaagctgtgaagccacagatgggctttcagtcggatgtttgcagctgcctact

SEQ ID NO: 566278 - DNA, 81 bp, Homo sapiens
aggaagttaggctgaggggcagagagcgagacttttctattttccaaaagctcggtctgaggcccctcagtcttgcttcct

SEQ ID NO: 566279 - DNA, 81 bp, Homo sapiens
ggctgccctggctcagttatcacagtgctgatgctgtctattctaaaggtacagtactgtgataactgaaggatggcagcc

SEQ ID NO: 566280 - DNA, 81 bp, Homo sapiens
gactatgcctccccgcatcccctagggcattggtgtaaagctggagacccactgccccaggtgctgctgggggttgtagtc

SEQ ID NO: 566281 - DNA, 80 bp, Homo sapiens
ctgttctgtgtatggcactggtagaattcactgtgaacagtctcagtcagtgaattaccgaagggccataaacagagcag

SEQ ID NO: 566282 - DNA, 80 bp, Homo sapiens
ggatcccctttgctttaacatgggggtacctgctgtgtgaaacaaaagtaagtgcttccatgtttcagtggaggtgtctc

SEQ ID NO: 566283 - DNA, 80 bp, Homo sapiens
aggacccttccagagggccccccctcaatcctgttgtgcctaattcagagggttgggtggaggctctcctgaagggctct

SEQ ID NO: 566284 - DNA, 80 bp, Homo sapiens
agtctgttgttgtaaacatccccgactggaagctgtaagacacagctaagctttcagtcagatgtttgctgctaccggct

SEQ ID NO: 566285 - DNA, 80 bp, Homo sapiens
tgggatgaggtagtaggttgtatagttttagggtcacacccaccactgggagataactatacaatctactgtctttccta

SEQ ID NO: 566286 - DNA, 80 bp, Homo sapiens
gggggcgagggattggagagaaaggcagttcctgatggtcccctccccaggggctggctttcctctggtccttccctccc

SEQ ID NO: 566287 - DNA, 80 bp, Homo sapiens
gtatcctcagctttgagaactgaattccatgggttgtgtcagtgtcagacctctgaaattcagttcttcagctgggatat

SEQ ID NO: 566288 - DNA, 80 bp, Homo sapiens
tatacaggaaaatgacctatgaattgacagacaatatagctgagtttgtctgtcatttctttaggccaatattctgtatg

SEQ ID NO: 566289 - DNA, 79 bp, Homo sapiens
gtccagggtgtgtgactggttgaccagaggggcatgcactgtgttcaccctgtgggccacctagtcaccaaccctcagc

SEQ ID NO: 566290 - DNA, 79 bp, Homo sapiens
ggtacttggagagaggtggtccgtggcgcgttcgctttatttatggcgcacattacacggtcgacctctttgcagtatc

SEQ ID NO: 566291 - DNA, 79 bp, Homo sapiens
ggtcacaatcaacattcattgctgtcggtgggttgaactgtgtggacaagctcactgaacaatgaatgcaactgtggcc

SEQ ID NO: 566292 - DNA, 79 bp, Homo sapiens
gggagctgagggctgggtctttgcgggcgagatgagggtgtcggatcaactggcctacaaagtcccagttctcggcccc

SEQ ID NO: 566293 - DNA, 79 bp, Homo sapiens
tctcccagcctgaggtgcagtgctgcatctctggtcagttgggagtctgagatgaagcactgtagctcaggaagagaga

SEQ ID NO: 566294 - DNA, 79 bp, Homo sapiens
cgctcccgccccgcgacgagcccctcgcacaaaccggacctgagcgttttgttcgttcggctcgcgtgaggcaggggcg

SEQ ID NO: 566295 - DNA, 79 bp, Homo sapiens
gctccgtcgccccagtgttcagactacctgttcaggacaatgccgttgtacagtagtctgcacattggttagactgggc

SEQ ID NO: 566296 - DNA, 78 bp, Homo sapiens
gcagtgggaaggggggccgatacactgtacgagagtgagtagcaggtctcacagtgaaccggtctctttccctactgt

SEQ ID NO: 566297 - DNA, 78 bp, Homo sapiens
gctttcctttgtgcttgatctaaccatgtggtggaacgatggaaacggaacatggttctgtcaagcaccgcggaaagc

SEQ ID NO: 566298 - DNA, 78 bp, Homo sapiens
cttgccctcaaggagctcacagtctattgagttacctttctgactttcccactagattgtgagctcctggagggcagg

SEQ ID NO: 566299 - DNA, 78 bp, Homo sapiens
cgctgggtccagtggttcttaacagttcaacagttctgtagcgcaattgtgaaatgtttaggaccactagacccggcg

SEQ ID NO: 566300 - DNA, 77 bp, Homo sapiens
gagccgcagtagttcttcagtggcaagctttatgtcctgacccagctaaagctgccagttgaagaactgttgccctc

SEQ ID NO: 566301 - DNA, 77 bp, Homo sapiens
gcttgggaaacatacttctttatatgcccatatggacctgctaagctatggaatgtaaagaagtatgtatctcaggc

SEQ ID NO: 566302 - DNA, 77 bp, Homo sapiens
ttcatccctgggtggggatttgttgcattacttgtgttctatataaagtattgcacttgtcccggcctgtggaagaa

SEQ ID NO: 566303 - DNA, 76 bp, Homo sapiens
tgagcgggggtcaagagcaataacgaaaaatgtttgtcataaaccgtttttcattattgctcctgacctcctctca

SEQ ID NO: 566304 - DNA, 76 bp, Homo sapiens
ggcctctgtgtgatatgtttgatatattaggttgttatttaatccaactatatatcaaacatattcctacagtgtc

SEQ ID NO: 566305 - DNA, 76 bp, Homo sapiens
gccctcggaggactccatttgttttgatgatggattcttatgctccatcatcgtctcaaatgagtcttcagagggt

SEQ ID NO: 566306 - DNA, 76 bp, Homo sapiens
ctgtctccagcctgctgaagctcagagggctctgattcagaaagatcatcggatccgtctgagcttggctggtcgg

SEQ ID NO: 566307 - DNA, 75 bp, Homo sapiens
agacagagaagccaggtcacgtctctgcagttacacagctcacgagtgcctgctggggtggaacctggtctgtct

SEQ ID NO: 566308 - DNA, 74 bp, Homo sapiens
ctgaagagatggtagactatggaacgtaggcgttatgatttctgacctatgtaacatggtccactaactctcag

SEQ ID NO: 566309 - DNA, 74 bp, Homo sapiens
caggaagctggtttcatatggtggtttagatttaaatagtgattgtctagcaccatttgaaatcagtgttcttg

SEQ ID NO: 566310 - DNA, 74 bp, Homo sapiens
cagatactgtaaacatcctacactctcagctgtggaaagtaagaaagctgggagaaggctgtttactctttctg

SEQ ID NO: 566311 - DNA, 72 bp, Homo sapiens
ctgcctctctgggcctgtgtcttaggctctgcaagatcaaccgagcaaagcacacggcctgcagagaggcag

SEQ ID NO: 566312 - DNA, 72 bp, Homo sapiens
tacatcggccattataatacaacctgataagtgttatagcacttatcagattgtattgtaattgtctgtgta

SEQ ID NO: 566313 - DNA, 71 bp, Homo sapiens
gtggcctatggcttttcattcctatgtgattgctgtcccaaactcatgtagggctaaaagccatgggctac

SEQ ID NO: 566314 - DNA, 71 bp, Homo sapiens
tgtggcttaggtagtttcatgttgttgggattgagttttgaactcggcaacaagaaactgcctgagttaca

SEQ ID NO: 566315 - DNA, 71 bp, Homo sapiens
agtgggcactcaataaatgtctgttgaattgaaatgcgttacattcaacgggtatttattgagcacccact

SEQ ID NO: 566316 - DNA, 71 bp, Homo sapiens
actttccaaagaattctccttttgggctttctggttttattttaagcccaaaggtgaattttttgggaagt

SEQ ID NO: 566317 - DNA, 70 bp, Homo sapiens
gttggattcggggccgtagcactgtctgagaggtttacatttctcacagtgaaccggtctctttttcagc

SEQ ID NO: 566318 - DNA, 70 bp, Homo sapiens
gtgaattaggtagtttcatgttgttgggcctgggtttctgaacacaacaacattaaaccacccgattcac

SEQ ID NO: 566319 - DNA, 69 bp, Homo sapiens
tatataccctgtagatccgaatttgtgtaaggaattttgtggtcacaaattcgtatctaggggaatatg

SEQ ID NO: 566320 - DNA, 69 bp, Homo sapiens
tgaaaagatggttgaccatagaacatgcgctatctctgtgtcgtatgtaatatggtccacatcttctca

SEQ ID NO: 566321 - DNA, 69 bp, Homo sapiens
ccaccacttaaacgtggatgtacttgctttgaaactaaagaagtaagtgcttccatgttttggtgatgg

SEQ ID NO: 566322 - DNA, 68 bp, Homo sapiens
ctctgcgtgttcacagcggaccttgatttaatgtctatacaattaaggcacgcggtgaatgccaagag

SEQ ID NO: 566323 - DNA, 68 bp, Homo sapiens
gcctctctgggcctgtgtcttaggctctgcaagatcaaccgagcaaagcacacggcctgcagagaggc

SEQ ID NO: 566324 - DNA, 68 bp, Homo sapiens
tggacttccctttgtcatcctatgcctgagaatatatgaaggaggctgggaaggcaaagggacgttca

SEQ ID NO: 566325 - DNA, 67 bp, Homo sapiens
tgagcatcttaccggacagtgctggatttcccagcttgactctaacactgtctggtaacgatgttca

SEQ ID NO: 566326 - DNA, 67 bp, Homo sapiens
ctagtccctgagaccctaacttgtgaggtattttagtaacatcacaagtcaggctcttgggacctag

SEQ ID NO: 566327 - DNA, 66 bp, Homo sapiens
ggctgggatatcatcatatactgtaagtttgcgatgagacactacagtatagatgatgtactagtc

SEQ ID NO: 566328 - DNA, 66 bp, Homo sapiens
gggcaaccgtggctttcgattgttactgtgggaactggaggtaacagtctacagccatggtcgccc

SEQ ID NO: 566329 - DNA, 65 bp, Homo sapiens
tggcactcaaactgtgggggcactttctgctctctggtgaaagtgccgccatcttttgagtgtta

SEQ ID NO: 566330 - DNA, 65 bp, Homo sapiens
tccacaccgtatctgacactttgggcgagggcaccatgctgaaggtgttcatgatgcggtctggg

SEQ ID NO: 566331 - DNA, 63 bp, Homo sapiens
ttttcggttatcatggtaccgatgctgtatatctgaaaggtacagtactgtgataactgaaga

SEQ ID NO: 566332 - DNA, 62 bp, Homo sapiens
ccgtgcctactgagctgaaacacagttggtttgtgtacactggctcagttcagcaggaacag

SEQ ID NO: 566333 - DNA, 60 bp, Homo sapiens
taatctcagctggcaactgtgagatgttcatacaatccctcacagtggtctctgggatta

SEQ ID NO: 566334 - DNA, 57 bp, Homo sapiens
catcttactgggcagcattggatggagtcaggtctctaatactgcctggtaatgatg

SEQ ID NO: 566335 - DNA, 56 bp, Homo sapiens
ttggtccagaggggagataggttcctgtgatttttccttcttctctatagaataaa

SEQ ID NO: 566336 - DNA, 55 bp, Homo sapiens
taggcagtgtagttagctgattgctaatagtaccaatcactaaccacacggccag

SEQ ID NO: 566337 - DNA, 55 bp, Homo sapiens
ggcaagatgctggcatagctgttgaactgggaacctgctatgccaacatattgcc

SEQ ID NO: 566338 - DNA, 24 bp, Homo sapiens
ctctaatactgcctggtaatgatg

SEQ ID NO: 566339 - DNA, 24 bp, Homo sapiens
ctggtttcacatggtggcttagat

SEQ ID NO: 566340 - DNA, 24 bp, Homo sapiens
agctacatctggctactgggtctc

SEQ ID NO: 566341 - DNA, 24 bp, Homo sapiens
caaagtgcttacagtgcaggtagt

SEQ ID NO: 566342 - DNA, 24 bp, Homo sapiens
tactgcatcaggaactgattggat

SEQ ID NO: 566343 - DNA, 24 bp, Homo sapiens
gtgcctactgagctgaaacacagt

SEQ ID NO: 566344 - DNA, 24 bp, Homo sapiens
gtccagttttcccaggaatccctt

SEQ ID NO: 566345 - DNA, 24 bp, Homo sapiens
tctcacacagaaatcgcacccgtc

SEQ ID NO: 566346 - DNA, 24 bp, Homo sapiens
aacattcattgctgtcggtgggtt

SEQ ID NO: 566347 - DNA, 24 bp, Homo sapiens
aaaagtgcttacagtgcaggtagc

SEQ ID NO: 566348 - DNA, 23 bp, Homo sapiens
aaaagctgggttgagagggcgaa

SEQ ID NO: 566349 - DNA, 23 bp, Homo sapiens
aaagtgctgcgacatttgagcgt

SEQ ID NO: 566350 - DNA, 23 bp, Homo sapiens
aaaatggtgccctagtgactaca

SEQ ID NO: 566351 - DNA, 23 bp, Homo sapiens
aacattcaacgctgtcggtgagt

SEQ ID NO: 566352 - DNA, 23 bp, Homo sapiens
actccatttgttttgatgatgga

SEQ ID NO: 566353 - DNA, 23 bp, Homo sapiens
actttaacatggaagtgctttct

SEQ ID NO: 566354 - DNA, 23 bp, Homo sapiens
tgaggggcagagagcgagacttt

SEQ ID NO: 566355 - DNA, 23 bp, Homo sapiens
tctttggttatctagctgtatga

SEQ ID NO: 566356 - DNA, 23 bp, Homo sapiens
tggagtgtgacaatggtgtttgt

SEQ ID NO: 566357 - DNA, 23 bp, Homo sapiens
tgtgcaaatccatgcaaaactga

SEQ ID NO: 566358 - DNA, 23 bp, Homo sapiens
tgtgcaaatctatgcaaaactga

SEQ ID NO: 566359 - DNA, 23 bp, Homo sapiens
tgtagtgtttcctactttatgga

SEQ ID NO: 566360 - DNA, 23 bp, Homo sapiens
tgtctgcccgcatgcctgcctct

SEQ ID NO: 566361 - DNA, 23 bp, Homo sapiens
tgtaaacatcctacactctcagc

SEQ ID NO: 566362 - DNA, 23 bp, Homo sapiens
tgtaaacatcctcgactggaagc

SEQ ID NO: 566363 - DNA, 23 bp, Homo sapiens
gtgcctactgagctgatatcagt

SEQ ID NO: 566364 - DNA, 23 bp, Homo sapiens
taagtgcttccatgtttcagtgg

SEQ ID NO: 566365 - DNA, 23 bp, Homo sapiens
taagtgcttccatgtttgagtgt

SEQ ID NO: 566366 - DNA, 23 bp, Homo sapiens
taagtgcttccatgttttagtag

SEQ ID NO: 566367 - DNA, 23 bp, Homo sapiens
taagtgcttccatgttttggtga

SEQ ID NO: 566368 - DNA, 23 bp, Homo sapiens
taccacagggtagaaccacggac

SEQ ID NO: 566369 - DNA, 23 bp, Homo sapiens
taccctgtagatccgaatttgtg

SEQ ID NO: 566370 - DNA, 23 bp, Homo sapiens
tatggctttttattcctatgtga

SEQ ID NO: 566371 - DNA, 23 bp, Homo sapiens
tccctgagaccctttaacctgtg

SEQ ID NO: 566372 - DNA, 23 bp, Homo sapiens
tccgtctcagttactttatagcc

SEQ ID NO: 566373 - DNA, 23 bp, Homo sapiens
tccagcatcagtgattttgttga

SEQ ID NO: 566374 - DNA, 23 bp, Homo sapiens
tccagctcctatatgatgccttt

SEQ ID NO: 566375 - DNA, 23 bp, Homo sapiens
tcaagagcaataacgaaaaatgt

SEQ ID NO: 566376 - DNA, 23 bp, Homo sapiens
tatggcactggtagaattcactg

SEQ ID NO: 566377 - DNA, 23 bp, Homo sapiens
caaagaattctccttttgggctt

SEQ ID NO: 566378 - DNA, 23 bp, Homo sapiens
caagtcactagtggttccgttta

SEQ ID NO: 566379 - DNA, 23 bp, Homo sapiens
caatcactaactccactgccatc

SEQ ID NO: 566380 - DNA, 23 bp, Homo sapiens
agctacattgtctgctgggtttc

SEQ ID NO: 566381 - DNA, 23 bp, Homo sapiens
agcagcattgtacagggctatca

SEQ ID NO: 566382 - DNA, 23 bp, Homo sapiens
agcagcattgtacagggctatga

SEQ ID NO: 566383 - DNA, 23 bp, Homo sapiens
atcacattgccagggattaccac

SEQ ID NO: 566384 - DNA, 23 bp, Homo sapiens
cagtgcaatagtattgtcaaagc

SEQ ID NO: 566385 - DNA, 23 bp, Homo sapiens
cccagtgttcagactacctgttc

SEQ ID NO: 566386 - DNA, 23 bp, Homo sapiens
cccagtgtttagactatctgttc

SEQ ID NO: 566387 - DNA, 23 bp, Homo sapiens
cgcatcccctagggcattggtgt

SEQ ID NO: 566388 - DNA, 23 bp, Homo sapiens
gaagtgcttcgattttggggtgt

SEQ ID NO: 566389 - DNA, 23 bp, Homo sapiens
ctggtttcacatggtggcttaga

SEQ ID NO: 566390 - DNA, 23 bp, Homo sapiens
gcaaagcacacggcctgcagaga

SEQ ID NO: 566391 - DNA, 22 bp, Homo sapiens
gcaatcatgtgcagtgccaata

SEQ ID NO: 566392 - DNA, 22 bp, Homo sapiens
gcacattacacggtcgacctct

SEQ ID NO: 566393 - DNA, 22 bp, Homo sapiens
gattcctggaaatactgttctt

SEQ ID NO: 566394 - DNA, 22 bp, Homo sapiens
gcccaaaggtgaattttttggg

SEQ ID NO: 566395 - DNA, 22 bp, Homo sapiens
gctgggaaggcaaagggacgtt

SEQ ID NO: 566396 - DNA, 22 bp, Homo sapiens
gctgggtctttgcgggcgagat

SEQ ID NO: 566397 - DNA, 22 bp, Homo sapiens
gctggtttcatatggtggttta

SEQ ID NO: 566398 - DNA, 22 bp, Homo sapiens
gcgaatcattatttgctgctct

SEQ ID NO: 566399 - DNA, 22 bp, Homo sapiens
gctatttcacgacaccagggtt

SEQ ID NO: 566400 - DNA, 22 bp, Homo sapiens
ggctacttcacaacaccagggc

SEQ ID NO: 566401 - DNA, 22 bp, Homo sapiens
ggcttctttacagtgctgcctt

SEQ ID NO: 566402 - DNA, 22 bp, Homo sapiens
gggagatcgaccgtgttatatt

SEQ ID NO: 566403 - DNA, 22 bp, Homo sapiens
gggctggctttcctctggtcct

SEQ ID NO: 566404 - DNA, 22 bp, Homo sapiens
gggctacaacacaggacccggg

SEQ ID NO: 566405 - DNA, 22 bp, Homo sapiens
gctgcgcttggatttcgtcccc

SEQ ID NO: 566406 - DNA, 22 bp, Homo sapiens
ggaacggcttcatacaggagtt

SEQ ID NO: 566407 - DNA, 22 bp, Homo sapiens
ggaagcccttaccccaaaaagt

SEQ ID NO: 566408 - DNA, 22 bp, Homo sapiens
ctgcaatgtaagcacttcttac

SEQ ID NO: 566409 - DNA, 22 bp, Homo sapiens
ctgcattatgagcacttaaagt

SEQ ID NO: 566410 - DNA, 22 bp, Homo sapiens
ctgggagaaggctgtttactct

SEQ ID NO: 566411 - DNA, 22 bp, Homo sapiens
ctgggaggtggatgtttacttc

SEQ ID NO: 566412 - DNA, 22 bp, Homo sapiens
ctggtttcacatggtggcttag

SEQ ID NO: 566413 - DNA, 22 bp, Homo sapiens
ctctgaaattcagttcttcagc

SEQ ID NO: 566414 - DNA, 22 bp, Homo sapiens
ctgcgcaagctactgccttgct

SEQ ID NO: 566415 - DNA, 22 bp, Homo sapiens
ctgctgagctagcacttcccga

SEQ ID NO: 566416 - DNA, 22 bp, Homo sapiens
ctggacttagggtcagaaggcc

SEQ ID NO: 566417 - DNA, 22 bp, Homo sapiens
ctggacttggagtcagaaggcc

SEQ ID NO: 566418 - DNA, 22 bp, Homo sapiens
ctggccctctctgcccttccgt

SEQ ID NO: 566419 - DNA, 22 bp, Homo sapiens
ctatacaatctactgtctttcc

SEQ ID NO: 566420 - DNA, 22 bp, Homo sapiens
ctatacgacctgctgcctttct

SEQ ID NO: 566421 - DNA, 22 bp, Homo sapiens
ctatacggcctcctagctttcc

SEQ ID NO: 566422 - DNA, 22 bp, Homo sapiens
ctcactgaacaatgaatgcaac

SEQ ID NO: 566423 - DNA, 22 bp, Homo sapiens
ctcccacatgcagggtttgcag

SEQ ID NO: 566424 - DNA, 22 bp, Homo sapiens
ctcctacatattagcattaaca

SEQ ID NO: 566425 - DNA, 22 bp, Homo sapiens
ctcctgactccaggtcctgtgt

SEQ ID NO: 566426 - DNA, 22 bp, Homo sapiens
cgggtagagagggcagtgggag

SEQ ID NO: 566427 - DNA, 22 bp, Homo sapiens
cgtgcctactgagctgaaacac

SEQ ID NO: 566428 - DNA, 22 bp, Homo sapiens
cgtgtatttgacaagctgagtt

SEQ ID NO: 566429 - DNA, 22 bp, Homo sapiens
ctagcaccatctgaaatcggtt

SEQ ID NO: 566430 - DNA, 22 bp, Homo sapiens
ctaggtatggtcccagggatcc

SEQ ID NO: 566431 - DNA, 22 bp, Homo sapiens
cgtgttcacagcggaccttgat

SEQ ID NO: 566432 - DNA, 22 bp, Homo sapiens
gaagttgttcgtggtggattcg

SEQ ID NO: 566433 - DNA, 22 bp, Homo sapiens
ctttcagtcagatgtttgctgc

SEQ ID NO: 566434 - DNA, 22 bp, Homo sapiens
ctttcagtcggatgtttacagc

SEQ ID NO: 566435 - DNA, 22 bp, Homo sapiens
ctttcagtcggatgtttgcagc

SEQ ID NO: 566436 - DNA, 22 bp, Homo sapiens
ctgtacaaccttctagctttcc

SEQ ID NO: 566437 - DNA, 22 bp, Homo sapiens
ctgtacagcctcctagctttcc

SEQ ID NO: 566438 - DNA, 22 bp, Homo sapiens
ctgtgggccacctagtcaccaa

SEQ ID NO: 566439 - DNA, 22 bp, Homo sapiens
ctgttctccattacttggctcg

SEQ ID NO: 566440 - DNA, 22 bp, Homo sapiens
gagctggtaaaatggaaccaaa

SEQ ID NO: 566441 - DNA, 22 bp, Homo sapiens
gagagttgagtctggacgtccc

SEQ ID NO: 566442 - DNA, 22 bp, Homo sapiens
gacagcacgacactgccttcat

SEQ ID NO: 566443 - DNA, 22 bp, Homo sapiens
gaggcggagacttgggcaattg

SEQ ID NO: 566444 - DNA, 22 bp, Homo sapiens
gagggagggacgggggctgtgc

SEQ ID NO: 566445 - DNA, 22 bp, Homo sapiens
cgagcttttggcccgggttata

SEQ ID NO: 566446 - DNA, 22 bp, Homo sapiens
cgaggttgccctttgtatattc

SEQ ID NO: 566447 - DNA, 22 bp, Homo sapiens
cctgctatgccaacatattgcc

SEQ ID NO: 566448 - DNA, 22 bp, Homo sapiens
cctggcatacaatgtagatttc

SEQ ID NO: 566449 - DNA, 22 bp, Homo sapiens
ccacagcactgcctggtcagaa

SEQ ID NO: 566450 - DNA, 22 bp, Homo sapiens
cctattcttgattacttgtttc

SEQ ID NO: 566451 - DNA, 22 bp, Homo sapiens
cctattcttggttacttgcacg

SEQ ID NO: 566452 - DNA, 22 bp, Homo sapiens
cctcaaatgtggagcactattc

SEQ ID NO: 566453 - DNA, 22 bp, Homo sapiens
ccactgaccgttgactgtacct

SEQ ID NO: 566454 - DNA, 22 bp, Homo sapiens
ccactgccccaggtgctgctgg

SEQ ID NO: 566455 - DNA, 22 bp, Homo sapiens
ccaggttctgtgatacactccg

SEQ ID NO: 566456 - DNA, 22 bp, Homo sapiens
cccctgaaagtccctcattttt

SEQ ID NO: 566457 - DNA, 22 bp, Homo sapiens
ccctcgaggagctcacagtcta

SEQ ID NO: 566458 - DNA, 22 bp, Homo sapiens
ccctgaacgaggggtctggagg

SEQ ID NO: 566459 - DNA, 22 bp, Homo sapiens
ccgcgacgagcccctcgcacaa

SEQ ID NO: 566460 - DNA, 22 bp, Homo sapiens
ccggaagcccttaccccaaaaa

SEQ ID NO: 566461 - DNA, 22 bp, Homo sapiens
cagtgcaatgatgaaagggcat

SEQ ID NO: 566462 - DNA, 22 bp, Homo sapiens
caggccatattgtgctgcctca

SEQ ID NO: 566463 - DNA, 22 bp, Homo sapiens
cagggacagcaaaggggtgctc

SEQ ID NO: 566464 - DNA, 22 bp, Homo sapiens
caggtgaggttcttgggagcct

SEQ ID NO: 566465 - DNA, 22 bp, Homo sapiens
caggttgggatcggttgcaatg

SEQ ID NO: 566466 - DNA, 22 bp, Homo sapiens
cagattcgattctaggggaata

SEQ ID NO: 566467 - DNA, 22 bp, Homo sapiens
cagcagcaattcatgttttgaa

SEQ ID NO: 566468 - DNA, 22 bp, Homo sapiens
cacgggttaggctcttgggagc

SEQ ID NO: 566469 - DNA, 22 bp, Homo sapiens
cactcaaactgtgggggcactt

SEQ ID NO: 566470 - DNA, 22 bp, Homo sapiens
cactcaataaatgtctgttgaa

SEQ ID NO: 566471 - DNA, 22 bp, Homo sapiens
catcttccagtacagtgttgga

SEQ ID NO: 566472 - DNA, 22 bp, Homo sapiens
catcatcgtctcaaatgagtct

SEQ ID NO: 566473 - DNA, 22 bp, Homo sapiens
catcccttgcatggtggagggt

SEQ ID NO: 566474 - DNA, 22 bp, Homo sapiens
catcttactgggcagcattgga

SEQ ID NO: 566475 - DNA, 22 bp, Homo sapiens
cagcttctttacagtgttgcct

SEQ ID NO: 566476 - DNA, 22 bp, Homo sapiens
ccaatattggctgtgctgctcc

SEQ ID NO: 566477 - DNA, 22 bp, Homo sapiens
cagtggttcttaacagttcaac

SEQ ID NO: 566478 - DNA, 22 bp, Homo sapiens
cattgcacttgtctcggtctga

SEQ ID NO: 566479 - DNA, 22 bp, Homo sapiens
atcacacaaaggcaacttttgt

SEQ ID NO: 566480 - DNA, 22 bp, Homo sapiens
ataagacgagcaaaaagcttgt

SEQ ID NO: 566481 - DNA, 22 bp, Homo sapiens
agtggagatgctgttacttttg

SEQ ID NO: 566482 - DNA, 22 bp, Homo sapiens
agtagtctgcacattggttagg

SEQ ID NO: 566483 - DNA, 22 bp, Homo sapiens
agtattaactgtgctgctgaag

SEQ ID NO: 566484 - DNA, 22 bp, Homo sapiens
agaattgtggctggacatctgt

SEQ ID NO: 566485 - DNA, 22 bp, Homo sapiens
agggcttagctgcttgtgagca

SEQ ID NO: 566486 - DNA, 22 bp, Homo sapiens
agcccctgcccaccgcacactg

SEQ ID NO: 566487 - DNA, 22 bp, Homo sapiens
agcctgctgaagctcagagggc

SEQ ID NO: 566488 - DNA, 22 bp, Homo sapiens
agcgcctcgacgacagagccgg

SEQ ID NO: 566489 - DNA, 22 bp, Homo sapiens
agctcggtctgaggcccctcag

SEQ ID NO: 566490 - DNA, 22 bp, Homo sapiens
aggagataactgtacaggccac

SEQ ID NO: 566491 - DNA, 22 bp, Homo sapiens
agaggtggtccgtggcgcgttc

SEQ ID NO: 566492 - DNA, 22 bp, Homo sapiens
agaggttgcccttggtgaattc

SEQ ID NO: 566493 - DNA, 22 bp, Homo sapiens
agatcagaaggtgattgtggct

SEQ ID NO: 566494 - DNA, 22 bp, Homo sapiens
aggcagtgtagttagctgattg

SEQ ID NO: 566495 - DNA, 22 bp, Homo sapiens
aggcagtgtcattagctgattg

SEQ ID NO: 566496 - DNA, 22 bp, Homo sapiens
caatcagcaagtatactgccct

SEQ ID NO: 566497 - DNA, 22 bp, Homo sapiens
caatttagtgtgtgtgatattt

SEQ ID NO: 566498 - DNA, 22 bp, Homo sapiens
cacatgcttctttatatcccca

SEQ ID NO: 566499 - DNA, 22 bp, Homo sapiens
caccaatattactgtgctgctt

SEQ ID NO: 566500 - DNA, 22 bp, Homo sapiens
cacccgtagaaccgaccttgcg

SEQ ID NO: 566501 - DNA, 22 bp, Homo sapiens
caatcactaactccactgccat

SEQ ID NO: 566502 - DNA, 22 bp, Homo sapiens
caaattcgtatctaggggaata

SEQ ID NO: 566503 - DNA, 22 bp, Homo sapiens
caacaaatcccagtctacctaa

SEQ ID NO: 566504 - DNA, 22 bp, Homo sapiens
caacggaatcccaaaagcagct

SEQ ID NO: 566505 - DNA, 22 bp, Homo sapiens
atggtgccctagtgactacaaa

SEQ ID NO: 566506 - DNA, 22 bp, Homo sapiens
atggttctgtcaagcaccgcgg

SEQ ID NO: 566507 - DNA, 22 bp, Homo sapiens
atgtagggctaaaagccatggg

SEQ ID NO: 566508 - DNA, 22 bp, Homo sapiens
atttcagtggagtgaagttcag

SEQ ID NO: 566509 - DNA, 22 bp, Homo sapiens
atcactaactccactgccatca

SEQ ID NO: 566510 - DNA, 22 bp, Homo sapiens
atcattcacggacaacactttt

SEQ ID NO: 566511 - DNA, 22 bp, Homo sapiens
atcgacaacaaatcacagtctg

SEQ ID NO: 566512 - DNA, 22 bp, Homo sapiens
tatggcttttcattcctatgtg

SEQ ID NO: 566513 - DNA, 22 bp, Homo sapiens
tcactgatcaatgaatgcaaac

SEQ ID NO: 566514 - DNA, 22 bp, Homo sapiens
tcagattgtattgtaattgtct

SEQ ID NO: 566515 - DNA, 22 bp, Homo sapiens
tcagttatcacagtgctgatgc

SEQ ID NO: 566516 - DNA, 22 bp, Homo sapiens
tcagttcctaatgcattgcctt

SEQ ID NO: 566517 - DNA, 22 bp, Homo sapiens
tcatcgtctcaaatgagtcttc

SEQ ID NO: 566518 - DNA, 22 bp, Homo sapiens
tcatttttgtgatgttgcagct

SEQ ID NO: 566519 - DNA, 22 bp, Homo sapiens
tccaacaatatcctggtgctga

SEQ ID NO: 566520 - DNA, 22 bp, Homo sapiens
tcacagtgaaccggtctctttc

SEQ ID NO: 566521 - DNA, 22 bp, Homo sapiens
tcacagtgaaccggtctctttt

SEQ ID NO: 566522 - DNA, 22 bp, Homo sapiens
tattgcacttgtcccggcctgt

SEQ ID NO: 566523 - DNA, 22 bp, Homo sapiens
tattgcttaagaatacgcgtag

SEQ ID NO: 566524 - DNA, 22 bp, Homo sapiens
tcaaaacgtgaggcgctgctat

SEQ ID NO: 566525 - DNA, 22 bp, Homo sapiens
tcagtgcactacagaactttgt

SEQ ID NO: 566526 - DNA, 22 bp, Homo sapiens
tcagtgcatcacagaactttgt

SEQ ID NO: 566527 - DNA, 22 bp, Homo sapiens
tcccccaggtgtgattctgatt

SEQ ID NO: 566528 - DNA, 22 bp, Homo sapiens
tccctgagaccctaacttgtga

SEQ ID NO: 566529 - DNA, 22 bp, Homo sapiens
tccttcattccaccggagtctg

SEQ ID NO: 566530 - DNA, 22 bp, Homo sapiens
tccgccttctcttcccggttct

SEQ ID NO: 566531 - DNA, 22 bp, Homo sapiens
tatgtaacatggtccactaact

SEQ ID NO: 566532 - DNA, 22 bp, Homo sapiens
tatgtaatatggtccacatctt

SEQ ID NO: 566533 - DNA, 22 bp, Homo sapiens
tattgaggacctcctatcaatc

SEQ ID NO: 566534 - DNA, 22 bp, Homo sapiens
tatatatcaaacatattcctac

SEQ ID NO: 566535 - DNA, 22 bp, Homo sapiens
tatcagaatctccaggggtact

SEQ ID NO: 566536 - DNA, 22 bp, Homo sapiens
tatacggcctcctagctttccc

SEQ ID NO: 566537 - DNA, 22 bp, Homo sapiens
tatagggattggagccgtggcg

SEQ ID NO: 566538 - DNA, 22 bp, Homo sapiens
tagcaccatttgaaatcggtta

SEQ ID NO: 566539 - DNA, 22 bp, Homo sapiens
taggttatccgtgttgccttcg

SEQ ID NO: 566540 - DNA, 22 bp, Homo sapiens
tagttcttcagtggcaagcttt

SEQ ID NO: 566541 - DNA, 22 bp, Homo sapiens
tagttttgcaggtttgcatcca

SEQ ID NO: 566542 - DNA, 22 bp, Homo sapiens
tatacaagggcaagctctctgt

SEQ ID NO: 566543 - DNA, 22 bp, Homo sapiens
taccgcactgtgggtacttgct

SEQ ID NO: 566544 - DNA, 22 bp, Homo sapiens
taccctgtagaaccgaatttgt

SEQ ID NO: 566545 - DNA, 22 bp, Homo sapiens
taccacagggtagaaccacgga

SEQ ID NO: 566546 - DNA, 22 bp, Homo sapiens
tactgccctaagtgctccttct

SEQ ID NO: 566547 - DNA, 22 bp, Homo sapiens
tactgttgctaatatgcaactc

SEQ ID NO: 566548 - DNA, 22 bp, Homo sapiens
tactttaacatggaggcacttg

SEQ ID NO: 566549 - DNA, 22 bp, Homo sapiens
tagattctccttctatgagtac

SEQ ID NO: 566550 - DNA, 22 bp, Homo sapiens
tagcagcacataatggtttgtg

SEQ ID NO: 566551 - DNA, 22 bp, Homo sapiens
tagcagcacatcatggtttaca

SEQ ID NO: 566552 - DNA, 22 bp, Homo sapiens
tagcagcacgtaaatattggcg

SEQ ID NO: 566553 - DNA, 22 bp, Homo sapiens
tagcttatcagactgatgttga

SEQ ID NO: 566554 - DNA, 22 bp, Homo sapiens
tacagtactgtgataactgaag

SEQ ID NO: 566555 - DNA, 22 bp, Homo sapiens
tacagtagtctgcacattggtt

SEQ ID NO: 566556 - DNA, 22 bp, Homo sapiens
tacagtatagatgatgtactag

SEQ ID NO: 566557 - DNA, 22 bp, Homo sapiens
tacatacttctttatgtaccca

SEQ ID NO: 566558 - DNA, 22 bp, Homo sapiens
taactatacaatctattgcctt

SEQ ID NO: 566559 - DNA, 22 bp, Homo sapiens
taaggtgcatctagtgcagata

SEQ ID NO: 566560 - DNA, 22 bp, Homo sapiens
taaagtgcttatagtgcaggta

SEQ ID NO: 566561 - DNA, 22 bp, Homo sapiens
taacactgtctggtaacgatgt

SEQ ID NO: 566562 - DNA, 22 bp, Homo sapiens
taacagtctacagccatggtcg

SEQ ID NO: 566563 - DNA, 22 bp, Homo sapiens
taaacgtggatgtacttgcttt

SEQ ID NO: 566564 - DNA, 22 bp, Homo sapiens
taaagacaacatttctgcacac

SEQ ID NO: 566565 - DNA, 22 bp, Homo sapiens
taaagcaatgagactgattgtc

SEQ ID NO: 566566 - DNA, 22 bp, Homo sapiens
gtgaaatgtttaggaccactag

SEQ ID NO: 566567 - DNA, 22 bp, Homo sapiens
ggtggggatttgttgcattact

SEQ ID NO: 566568 - DNA, 22 bp, Homo sapiens
ggtggatattccttctatgttt

SEQ ID NO: 566569 - DNA, 22 bp, Homo sapiens
gggttgggtggaggctctcctg

SEQ ID NO: 566570 - DNA, 22 bp, Homo sapiens
ggggggcaggaggggctcaggg

SEQ ID NO: 566571 - DNA, 22 bp, Homo sapiens
ggggtgctatctgtgattgagg

SEQ ID NO: 566572 - DNA, 22 bp, Homo sapiens
tgtaacagcaactccatgtgga

SEQ ID NO: 566573 - DNA, 22 bp, Homo sapiens
tgtagggatggaagccatgaaa

SEQ ID NO: 566574 - DNA, 22 bp, Homo sapiens
tggttgaccatagaacatgcgc

SEQ ID NO: 566575 - DNA, 22 bp, Homo sapiens
tggtttaccgtcccacatacat

SEQ ID NO: 566576 - DNA, 22 bp, Homo sapiens
tggtttcacatggtggcttaga

SEQ ID NO: 566577 - DNA, 22 bp, Homo sapiens
tgtaaacatccccgactggaag

SEQ ID NO: 566578 - DNA, 22 bp, Homo sapiens
ttaaacaattcctagacaatat

SEQ ID NO: 566579 - DNA, 22 bp, Homo sapiens
ttaaggcacgcggtgaatgcca

SEQ ID NO: 566580 - DNA, 22 bp, Homo sapiens
ttaatgctaatcgtgatagggg

SEQ ID NO: 566581 - DNA, 22 bp, Homo sapiens
ttagttttgcatagttgcacta

SEQ ID NO: 566582 - DNA, 22 bp, Homo sapiens
ttataatacaacctgataagtg

SEQ ID NO: 566583 - DNA, 22 bp, Homo sapiens
ttatcacttttccagcccagct

SEQ ID NO: 566584 - DNA, 22 bp, Homo sapiens
ttatcagaatctccaggggtac

SEQ ID NO: 566585 - DNA, 22 bp, Homo sapiens
ttcaacgggtatttattgagca

SEQ ID NO: 566586 - DNA, 22 bp, Homo sapiens
ttcaagtaatccaggataggct

SEQ ID NO: 566587 - DNA, 22 bp, Homo sapiens
ttgggttcctggcatgctgatt

SEQ ID NO: 566588 - DNA, 22 bp, Homo sapiens
ttggtccccttcaaccagctgt

SEQ ID NO: 566589 - DNA, 22 bp, Homo sapiens
ttttgcaggtttgcatttcagc

SEQ ID NO: 566590 - DNA, 22 bp, Homo sapiens
tttaacatgggggtacctgctg

SEQ ID NO: 566591 - DNA, 22 bp, Homo sapiens
tttggcaatggtagaactcaca

SEQ ID NO: 566592 - DNA, 22 bp, Homo sapiens
tttggcactagcacatttttgc

SEQ ID NO: 566593 - DNA, 22 bp, Homo sapiens
tttgttcgttcggctcgcgtga

SEQ ID NO: 566594 - DNA, 22 bp, Homo sapiens
ttttcattattgctcctgacct

SEQ ID NO: 566595 - DNA, 22 bp, Homo sapiens
ttttcggttatcatggtaccga

SEQ ID NO: 566596 - DNA, 22 bp, Homo sapiens
ttccctttgtcatcctatgcct

SEQ ID NO: 566597 - DNA, 22 bp, Homo sapiens
ttccctttgtcatccttcgcct

SEQ ID NO: 566598 - DNA, 22 bp, Homo sapiens
ttcggggccgtagcactgtctg

SEQ ID NO: 566599 - DNA, 22 bp, Homo sapiens
tgtgggatggtaaaccgcttct

SEQ ID NO: 566600 - DNA, 22 bp, Homo sapiens
tgttctaggtatggtcccaggg

SEQ ID NO: 566601 - DNA, 22 bp, Homo sapiens
ttcacagtggctaagttccgcc

SEQ ID NO: 566602 - DNA, 22 bp, Homo sapiens
ttcagcttctttacagtgctgc

SEQ ID NO: 566603 - DNA, 22 bp, Homo sapiens
tgtcatttttgtgatctgcagc

SEQ ID NO: 566604 - DNA, 22 bp, Homo sapiens
ttcaccaccttctccacccagc

SEQ ID NO: 566605 - DNA, 22 bp, Homo sapiens
tggaggcagggcctttgtgaag

SEQ ID NO: 566606 - DNA, 22 bp, Homo sapiens
tggagacgcggccctgttggag

SEQ ID NO: 566607 - DNA, 22 bp, Homo sapiens
tggcagtgtcttagctggttgt

SEQ ID NO: 566608 - DNA, 22 bp, Homo sapiens
tggctcagtagccagtgtagat

SEQ ID NO: 566609 - DNA, 22 bp, Homo sapiens
tggctcagttcagcaggaacag

SEQ ID NO: 566610 - DNA, 22 bp, Homo sapiens
tgggctctctgtccctgagcca

SEQ ID NO: 566611 - DNA, 22 bp, Homo sapiens
tggggttcctggggatgggatt

SEQ ID NO: 566612 - DNA, 22 bp, Homo sapiens
tggtacaggcctgggggacagg

SEQ ID NO: 566613 - DNA, 22 bp, Homo sapiens
tggctgccaattccataggtca

SEQ ID NO: 566614 - DNA, 22 bp, Homo sapiens
tggctggtcaaacggaaccaag

SEQ ID NO: 566615 - DNA, 22 bp, Homo sapiens
tgggagagggttgtttactcct

SEQ ID NO: 566616 - DNA, 22 bp, Homo sapiens
tgggatatcatcatatactgta

SEQ ID NO: 566617 - DNA, 22 bp, Homo sapiens
tgcaatgtttccacagtgcatc

SEQ ID NO: 566618 - DNA, 22 bp, Homo sapiens
tgaggtgcagtgctgcatctct

SEQ ID NO: 566619 - DNA, 22 bp, Homo sapiens
tgatatgtttgatatattaggt

SEQ ID NO: 566620 - DNA, 22 bp, Homo sapiens
tgaggtagtaagttgtattgtt

SEQ ID NO: 566621 - DNA, 22 bp, Homo sapiens
tgaggtagtagattgtatagtt

SEQ ID NO: 566622 - DNA, 22 bp, Homo sapiens
tgaggtagtaggttgtatagtt

SEQ ID NO: 566623 - DNA, 22 bp, Homo sapiens
tgaggtagtaggttgtatggtt

SEQ ID NO: 566624 - DNA, 22 bp, Homo sapiens
tgaggtagtaggttgtgtggtt

SEQ ID NO: 566625 - DNA, 22 bp, Homo sapiens
tgctctgactttattgcactac

SEQ ID NO: 566626 - DNA, 22 bp, Homo sapiens
tgcctgtctacacttgctgtgc

SEQ ID NO: 566627 - DNA, 22 bp, Homo sapiens
tggaatgtaaggaagtgtgtgg

SEQ ID NO: 566628 - DNA, 22 bp, Homo sapiens
tggacggagaactgataagggt

SEQ ID NO: 566629 - DNA, 22 bp, Homo sapiens
tcttttcacattgtgctactgt

SEQ ID NO: 566630 - DNA, 22 bp, Homo sapiens
tgaggggcagagagcgagactt

SEQ ID NO: 566631 - DNA, 22 bp, Homo sapiens
tgaaggtgttcatgatgcggtc

SEQ ID NO: 566632 - DNA, 22 bp, Homo sapiens
tgaagttctgttatacactcag

SEQ ID NO: 566633 - DNA, 22 bp, Homo sapiens
tgaattaccgaagggccataaa

SEQ ID NO: 566634 - DNA, 22 bp, Homo sapiens
tgaccgatttctcctggtgttc

SEQ ID NO: 566635 - DNA, 22 bp, Homo sapiens
tgacgggtattcttgggtggat

SEQ ID NO: 566636 - DNA, 22 bp, Homo sapiens
tgagaactgaattccatgggtt

SEQ ID NO: 566637 - DNA, 22 bp, Homo sapiens
tgagatgaagcactgtagctca

SEQ ID NO: 566638 - DNA, 22 bp, Homo sapiens
tgagcatcttaccggacagtgc

SEQ ID NO: 566639 - DNA, 22 bp, Homo sapiens
tctcccaacccttgtaccagtg

SEQ ID NO: 566640 - DNA, 22 bp, Homo sapiens
tcgtcttacccagcagtgtttg

SEQ ID NO: 566641 - DNA, 22 bp, Homo sapiens
tcgaggagctcacagtctagta

SEQ ID NO: 566642 - DNA, 22 bp, Homo sapiens
tcggatccgtctgagcttggct

SEQ ID NO: 566643 - DNA, 22 bp, Homo sapiens
tcggcaacaagaaactgcctga

SEQ ID NO: 566644 - DNA, 22 bp, Homo sapiens
tctctgggcctgtgtcttaggc

SEQ ID NO: 566645 - DNA, 22 bp, Homo sapiens
tctggctccgtgtcttcactcc

SEQ ID NO: 566646 - DNA, 22 bp, Homo sapiens
tctgggcctgtgtcttaggctc

SEQ ID NO: 566647 - DNA, 22 bp, Homo sapiens
tctgtcatttctttaggccaat

SEQ ID NO: 566648 - DNA, 22 bp, Homo sapiens
agaagttgttcgtggtggattc

SEQ ID NO: 566649 - DNA, 22 bp, Homo sapiens
agagcttagctgattggtgaac

SEQ ID NO: 566650 - DNA, 22 bp, Homo sapiens
actctttccctgttgcactact

SEQ ID NO: 566651 - DNA, 22 bp, Homo sapiens
actgatttcttttggtgttcag

SEQ ID NO: 566652 - DNA, 22 bp, Homo sapiens
accactgaccgttgactgtacc

SEQ ID NO: 566653 - DNA, 22 bp, Homo sapiens
accatcgaccgttgagtggacc

SEQ ID NO: 566654 - DNA, 22 bp, Homo sapiens
accatcgaccgttgattgtacc

SEQ ID NO: 566655 - DNA, 22 bp, Homo sapiens
acatagaggaaattccacgttt

SEQ ID NO: 566656 - DNA, 22 bp, Homo sapiens
acaagtcaggctcttgggacct

SEQ ID NO: 566657 - DNA, 22 bp, Homo sapiens
acacaagctcgtgtctgtgggt

SEQ ID NO: 566658 - DNA, 22 bp, Homo sapiens
aattgcactttagcaatggtga

SEQ ID NO: 566659 - DNA, 22 bp, Homo sapiens
acaacattaaaccacccgattc

SEQ ID NO: 566660 - DNA, 22 bp, Homo sapiens
accttggctctagactgcttac

SEQ ID NO: 566661 - DNA, 22 bp, Homo sapiens
acgccattatcacactaaatag

SEQ ID NO: 566662 - DNA, 22 bp, Homo sapiens
acggatgtttgagcatgtgcta

SEQ ID NO: 566663 - DNA, 22 bp, Homo sapiens
actagactgaagctccttgagg

SEQ ID NO: 566664 - DNA, 22 bp, Homo sapiens
actagattgtgagctcctggag

SEQ ID NO: 566665 - DNA, 22 bp, Homo sapiens
actatacaacttactactttcc

SEQ ID NO: 566666 - DNA, 22 bp, Homo sapiens
actcaaaatgggggcgctttcc

SEQ ID NO: 566667 - DNA, 22 bp, Homo sapiens
aatcattcacggacaacacttt

SEQ ID NO: 566668 - DNA, 22 bp, Homo sapiens
aatcatacacggttgacctatt

SEQ ID NO: 566669 - DNA, 22 bp, Homo sapiens
aatactgccgggtaatgatgga

SEQ ID NO: 566670 - DNA, 22 bp, Homo sapiens
aagcccttaccccaaaaagcat

SEQ ID NO: 566671 - DNA, 22 bp, Homo sapiens
aagctcgcttctatgggtctgt

SEQ ID NO: 566672 - DNA, 22 bp, Homo sapiens
aagctgccagttgaagaactgt

SEQ ID NO: 566673 - DNA, 22 bp, Homo sapiens
aagcttgtatctataggtatgt

SEQ ID NO: 566674 - DNA, 22 bp, Homo sapiens
aaggagctcacagtctattgag

SEQ ID NO: 566675 - DNA, 22 bp, Homo sapiens
aaggggggccgatacactgtac

SEQ ID NO: 566676 - DNA, 22 bp, Homo sapiens
aaggtagattctccttctatga

SEQ ID NO: 566677 - DNA, 22 bp, Homo sapiens
aaacatggttccgtcaagcacc

SEQ ID NO: 566678 - DNA, 22 bp, Homo sapiens
aacaagtcacagccggcctcat

SEQ ID NO: 566679 - DNA, 22 bp, Homo sapiens
aaagtgctgttcgtgcaggtag

SEQ ID NO: 566680 - DNA, 22 bp, Homo sapiens
aaagttctgagacactccgact

SEQ ID NO: 566681 - DNA, 22 bp, Homo sapiens
aacccgtagatccgaacttgtg

SEQ ID NO: 566682 - DNA, 22 bp, Homo sapiens
aacccgtagatccgatcttgtg

SEQ ID NO: 566683 - DNA, 22 bp, Homo sapiens
aaccgtggctttcgattgttac

SEQ ID NO: 566684 - DNA, 22 bp, Homo sapiens
aacaccagtcgatgggctgtct

SEQ ID NO: 566685 - DNA, 22 bp, Homo sapiens
aacatacttctttatatgccca

SEQ ID NO: 566686 - DNA, 22 bp, Homo sapiens
aacattcaacctgtcggtgagt

SEQ ID NO: 566687 - DNA, 21 bp, Homo sapiens
aacactgtctggtaaagatgg

SEQ ID NO: 566688 - DNA, 21 bp, Homo sapiens
aactggcctacaaagtcccag

SEQ ID NO: 566689 - DNA, 21 bp, Homo sapiens
aaatggtgccctagtgactac

SEQ ID NO: 566690 - DNA, 21 bp, Homo sapiens
aacaatatcctggtgctgagt

SEQ ID NO: 566691 - DNA, 21 bp, Homo sapiens
aataatacatggttgatcttt

SEQ ID NO: 566692 - DNA, 21 bp, Homo sapiens
aatcactaactccactgccat

SEQ ID NO: 566693 - DNA, 21 bp, Homo sapiens
aatcattcacggacaacactt

SEQ ID NO: 566694 - DNA, 21 bp, Homo sapiens
acaagtcaggctcttgggacc

SEQ ID NO: 566695 - DNA, 21 bp, Homo sapiens
acagcaggcacagacaggcag

SEQ ID NO: 566696 - DNA, 21 bp, Homo sapiens
agaggtagtaggttgcatagt

SEQ ID NO: 566697 - DNA, 21 bp, Homo sapiens
tctctgggcctgtgtcttagg

SEQ ID NO: 566698 - DNA, 21 bp, Homo sapiens
tcgtaccgtgagtaataatgc

SEQ ID NO: 566699 - DNA, 21 bp, Homo sapiens
tcgtgtcttgtgttgcagccg

SEQ ID NO: 566700 - DNA, 21 bp, Homo sapiens
tgaggtaggaggttgtatagt

SEQ ID NO: 566701 - DNA, 21 bp, Homo sapiens
tgctgactcctagtccagggc

SEQ ID NO: 566702 - DNA, 21 bp, Homo sapiens
tggaagactagtgattttgtt

SEQ ID NO: 566703 - DNA, 21 bp, Homo sapiens
tggaatgtaaagaagtatgta

SEQ ID NO: 566704 - DNA, 21 bp, Homo sapiens
tgaggtagtagtttgtacagt

SEQ ID NO: 566705 - DNA, 21 bp, Homo sapiens
tgattgtccaaacgcaattct

SEQ ID NO: 566706 - DNA, 21 bp, Homo sapiens
ttgtgcttgatctaaccatgt

SEQ ID NO: 566707 - DNA, 21 bp, Homo sapiens
ttggtccccttcaaccagcta

SEQ ID NO: 566708 - DNA, 21 bp, Homo sapiens
ttcaagtaattcaggataggt

SEQ ID NO: 566709 - DNA, 21 bp, Homo sapiens
tgtgactggttgaccagaggg

SEQ ID NO: 566710 - DNA, 21 bp, Homo sapiens
tgtcagtttgtcaaatacccc

SEQ ID NO: 566711 - DNA, 21 bp, Homo sapiens
tgtaaacatcctacactcagc

SEQ ID NO: 566712 - DNA, 21 bp, Homo sapiens
tggttctagacttgccaacta

SEQ ID NO: 566713 - DNA, 21 bp, Homo sapiens
taaagctagataaccgaaagt

SEQ ID NO: 566714 - DNA, 21 bp, Homo sapiens
taaagtgctgacagtgcagat

SEQ ID NO: 566715 - DNA, 21 bp, Homo sapiens
gtgccgccatcttttgagtgt

SEQ ID NO: 566716 - DNA, 21 bp, Homo sapiens
taacagtctccagtcacggcc

SEQ ID NO: 566717 - DNA, 21 bp, Homo sapiens
taatctcagctggcaactgtg

SEQ ID NO: 566718 - DNA, 21 bp, Homo sapiens
tagcagcacagaaatattggc

SEQ ID NO: 566719 - DNA, 21 bp, Homo sapiens
taggtagtttcatgttgttgg

SEQ ID NO: 566720 - DNA, 21 bp, Homo sapiens
taggtagtttcctgttgttgg

SEQ ID NO: 566721 - DNA, 21 bp, Homo sapiens
tattgcacattactaagttgc

SEQ ID NO: 566722 - DNA, 21 bp, Homo sapiens
tccctgtcctccaggagctca

SEQ ID NO: 566723 - DNA, 21 bp, Homo sapiens
tcgaggagctcacagtctagt

SEQ ID NO: 566724 - DNA, 21 bp, Homo sapiens
tcagtgcatgacagaacttgg

SEQ ID NO: 566725 - DNA, 21 bp, Homo sapiens
tcacagtggtctctgggatta

SEQ ID NO: 566726 - DNA, 21 bp, Homo sapiens
atcgggaatgtcgtgtccgcc

SEQ ID NO: 566727 - DNA, 21 bp, Homo sapiens
atgacctatgaattgacagac

SEQ ID NO: 566728 - DNA, 21 bp, Homo sapiens
atcatagaggaaaatccacgt

SEQ ID NO: 566729 - DNA, 21 bp, Homo sapiens
atcatcgtctcaaatgagtct

SEQ ID NO: 566730 - DNA, 21 bp, Homo sapiens
attcctggaaatactgttctt

SEQ ID NO: 566731 - DNA, 21 bp, Homo sapiens
caagctcgcttctatgggtct

SEQ ID NO: 566732 - DNA, 21 bp, Homo sapiens
agggccccccctcaatcctgt

SEQ ID NO: 566733 - DNA, 21 bp, Homo sapiens
ataaggatttttaggggcatt

SEQ ID NO: 566734 - DNA, 21 bp, Homo sapiens
agtggttttaccctatggtag

SEQ ID NO: 566735 - DNA, 21 bp, Homo sapiens
atcacattgccagggatttcc

SEQ ID NO: 566736 - DNA, 21 bp, Homo sapiens
cattattacttttggtacgcg

SEQ ID NO: 566737 - DNA, 21 bp, Homo sapiens
ccacaccgtatctgacacttt

SEQ ID NO: 566738 - DNA, 21 bp, Homo sapiens
ccacagcactgcctggtcaga

SEQ ID NO: 566739 - DNA, 21 bp, Homo sapiens
cctagtaggtgtccagtaagt

SEQ ID NO: 566740 - DNA, 21 bp, Homo sapiens
ctgtgcgtgtgacagcggctg

SEQ ID NO: 566741 - DNA, 21 bp, Homo sapiens
ctttttgcggtctgggcttgc

SEQ ID NO: 566742 - DNA, 21 bp, Homo sapiens
cgaatcattatttgctgctct

SEQ ID NO: 566743 - DNA, 21 bp, Homo sapiens
cgtgttcacagcggaccttga

SEQ ID NO: 566744 - DNA, 21 bp, Homo sapiens
ctgacctatgaattgacagcc

SEQ ID NO: 566745 - DNA, 21 bp, Homo sapiens
ggcaagatgctggcatagctg

SEQ ID NO: 566746 - DNA, 21 bp, Homo sapiens
gctacttcacaacaccagggc

SEQ ID NO: 566747 - DNA, 21 bp, Homo sapiens
gcccctgggcctatcctagaa

SEQ ID NO: 566748 - DNA, 21 bp, Homo sapiens
gcctgctggggtggaacctgg

SEQ ID NO: 566749 - DNA, 20 bp, Homo sapiens
cctctgggcccttcctccag

SEQ ID NO: 566750 - DNA, 20 bp, Homo sapiens
cgaatcattatttgctgctc

SEQ ID NO: 566751 - DNA, 20 bp, Homo sapiens
cataaagtagaaagcactac

SEQ ID NO: 566752 - DNA, 20 bp, Homo sapiens
cagtgcaatgttaaaagggc

SEQ ID NO: 566753 - DNA, 20 bp, Homo sapiens
atcactaaccacacggccag

SEQ ID NO: 566754 - DNA, 20 bp, Homo sapiens
atacggcctcctagctttcc

SEQ ID NO: 566755 - DNA, 20 bp, Homo sapiens
attcctagaaattgttcata

SEQ ID NO: 566756 - DNA, 20 bp, Homo sapiens
attcctggaaatactgttct

SEQ ID NO: 566757 - DNA, 20 bp, Homo sapiens
tcaaatgctcagactcctgt

SEQ ID NO: 566758 - DNA, 20 bp, Homo sapiens
tagcaccatttgaaatcagt

SEQ ID NO: 566759 - DNA, 20 bp, Homo sapiens
gtgtgtggaaatgcttctgc

SEQ ID NO: 566760 - DNA, 20 bp, Homo sapiens
tgtaaacatccttgactgga

SEQ ID NO: 566761 - DNA, 20 bp, Homo sapiens
ttgcatagtcacaaaagtga

SEQ ID NO: 566762 - DNA, 20 bp, Homo sapiens
ttcacagtggctaagttctg

SEQ ID NO: 566763 - DNA, 20 bp, Homo sapiens
agaattgtggctggacatct

SEQ ID NO: 566764 - DNA, 20 bp, Homo sapiens
actgcagtgaaggcacttgt

SEQ ID NO: 566765 - DNA, 20 bp, Homo sapiens
aagcccttaccccaaaaagc

SEQ ID NO: 566766 - DNA, 19 bp, Homo sapiens
aaaatggtgccctagtgac

SEQ ID NO: 566767 - DNA, 19 bp, Homo sapiens
ttcttctctatagaataaa

SEQ ID NO: 566768 - DNA, 19 bp, Homo sapiens
tggtagactatggaacgta

SEQ ID NO: 566769 - DNA, 19 bp, Homo sapiens
tgaggtagtagtttgtgct

SEQ ID NO: 566770 - DNA, 19 bp, Homo sapiens
gtgcctactgagctgaaac

SEQ ID NO: 566771 - DNA, 19 bp, Homo sapiens
gtgcattgtagttgcattg

SEQ ID NO: 566772 - DNA, 19 bp, Homo sapiens
ggtccagaggggagatagg

SEQ ID NO: 566773 - DNA, 19 bp, Homo sapiens
atcagaaggtgattgtggc

SEQ ID NO: 566774 - DNA, 19 bp, Homo sapiens
cgaatcattatttgctgct

SEQ ID NO: 566775 - DNA, 18 bp, Homo sapiens
tggagagaaaggcagttc

SEQ ID NO: 566776 - DNA, 18 bp, Homo sapiens
tctacagtgcacgtgtct

SEQ ID NO: 566777 - DNA, 17 bp, Homo sapiens
tcaggctcttgggacct

SEQ ID NO: 566778 - DNA, 17 bp, Homo sapiens
agctggtgttgtgaatc
